(12) United States Patent
Toledo et al.

(10) Patent No.: US 10,131,897 B2
(45) Date of Patent: Nov. 20, 2018

(54) MOLECULES ASSOCIATED WITH FATTY ACID BIOSYNTHETIC PATHWAYS AND USES THEREOF

(71) Applicant: Synthetic Genomics, Inc., La Jolla, CA (US)

(72) Inventors: Gerardo V. Toledo, Belmont, MA (US); Karen D. Xu, San Diego, CA (US); Jun Urano, Irvine, CA (US)

(73) Assignee: Synthetics Genomics, Inc., La Jolla, CA (US)

( * ) Notice: Subject to any disclaimer, the term of this patent is extended or adjusted under 35 U.S.C. 154(b) by 0 days.

(21) Appl. No.: 14/637,356

(22) Filed: Mar. 3, 2015

(65) Prior Publication Data

US 2016/0122741 A1    May 5, 2016

Related U.S. Application Data

(60) Provisional application No. 61/947,317, filed on Mar. 3, 2014, provisional application No. 62/127,196, filed on Mar. 2, 2015.

(51) Int. Cl.
| | |
|---|---|
| *C12N 15/52* | (2006.01) |
| *C12P 7/64* | (2006.01) |
| *C12N 9/00* | (2006.01) |
| *C12N 9/10* | (2006.01) |

(52) U.S. Cl.
CPC ............. *C12N 9/93* (2013.01); *C12N 9/1029* (2013.01); *C12N 15/52* (2013.01); *C12P 7/6427* (2013.01); *C12Y 604/00* (2013.01)

(58) Field of Classification Search
None
See application file for complete search history.

(56) References Cited

U.S. PATENT DOCUMENTS

| | | |
|---|---|---|
| 6,140,486 A | 10/2000 | Facciotti et al. |
| 6,566,583 B1 | 5/2003 | Facciotti et al. |
| 7,208,590 B2 | 4/2007 | Mukerji et al. |
| 7,217,856 B2 | 5/2007 | Weaver et al. |
| 7,560,539 B2 | 7/2009 | Weaver et al. |
| 7,601,522 B2 | 10/2009 | Weaver et al. |
| 7,611,874 B2 | 11/2009 | Metz et al. |
| 7,626,009 B2 | 12/2009 | Weaver et al. |
| 7,718,431 B2 | 5/2010 | Weaver et al. |
| 7,729,450 B2 | 6/2010 | Thor et al. |
| 7,799,564 B2 | 9/2010 | Weaver et al. |
| 7,803,620 B2 | 9/2010 | Weaver et al. |
| 7,879,608 B2 | 2/2011 | Weaver et al. |
| 7,897,391 B2 | 3/2011 | Weaver et al. |
| 7,897,392 B2 | 3/2011 | Weaver et al. |
| 7,897,393 B2 | 3/2011 | Metz et al. |
| 7,897,844 B2 | 3/2011 | Weaver et al. |
| 7,902,427 B2 | 3/2011 | Weaver et al. |
| 7,906,706 B2 | 3/2011 | Weaver et al. |
| 7,939,716 B2 | 5/2011 | Weaver et al. |
| 2008/0032369 A1 | 2/2008 | Weaver et al. |
| 2008/0044868 A1 | 2/2008 | Metz et al. |
| 2013/0309772 A1 | 11/2013 | Sakaguchi et al. |

FOREIGN PATENT DOCUMENTS

EP    2 390 343 A1    11/2011

OTHER PUBLICATIONS

Okuyama et al.: "Bacterial Genes Responsible for the Biosynthesis of Eicosapentaenoic and Docosahexaenoic Acids and Their Heterologous Expression"; Applied and Environmental Microbiology, Feb. 2007, vol. 73, No. 3, pp. 665-670.

Xie et al.: "Sustainable Source of Omega-3 Eicosapentaenoic Acid From Metabolically Engineered Yarrowia Lipolytica::From Fundamental Research to Commercial Production"; Applied and Environmental Microbiology, Jan. 8, 2015, vol. 99, pp. 1599-1610.

International Search Report dated Jul. 30, 2015, regarding PCT/US2015/018549.

Allen, et al.: "Structure and Regulation of the Omega-3 Polyunsaturated Fatty Acid Synthase Genes from the Deep-Sea Bacterium Photobacterium profundum SS9;" Microbiology. 2002, vol. 148, pp. 1903-1913.

Amiri-Jami, et al.: "Recombinant Production of Omega-3 Fatty Acids in Escherichia coli using a Gene Cluster Isolated from Shewanella baltica MAC1;" J. Applied Microbiology, 2010, vol. 109, pp. 1897-1905.

Bromberg, et al.: "SNAP Predicts Effect of Mutations on Protein Function;" Bioinformatics, Oct. 15, 2008, vol. 24, Iss. 20, pp. 2397-2398.

Guo, et al.: "Protein Tolerance to Random Amino Acid Change;" PNAS USA, Jun. 22, 2014, vol. 101, Iss. 25, pp. 9205-9210.

Mayer, et al.: "Linking Enzyme Sequence to Function using Conserved Property Difference Locator to Identify and Annotate Positions Likely to Control Specific Functionality;" BMC Bioinformatics, Nov. 30, 2005, vol. 6, p. 284.

Ng, et al.: "SIFT: Predicting Amino Acid Changes that Affect Protein Function;" Nucleic Acids Research, Jul. 1, 2003, vol. 31, Iss. 13, pp. 3812-3814.

Orikasa, et al.: "A Phosphopantetheinyl Transferase Gene Essential for Biosynthesis of n-3 Polyunsaturated Fatty Acids from Moritella marina strain MP-1;" FEBS Letters, Jul. 13, 2006, vol. 580, pp. 4423-4429.

Orikasa, et al.: "pfaB Products Determine the Molecular Species Produced in Bacterial Polyunsaturated Fatty Acid Biosynthesis;"FEMS Microbiology Letters, Apr. 21, 2009, vol. 295, pp. 170-176.

Ratledge, Colin: "Fatty Acid Biosynthesis in Microorganisms being used for Single Cell Oil Production;" Biochimie, Oct. 19, 2004, vol. 86, pp. 807-815.

(Continued)

Primary Examiner — Rebecca E Prouty
(74) Attorney, Agent, or Firm — DLA Piper LLP (US)

(57) ABSTRACT

The present disclosure relates in part to recombinant microorganisms that include non-native genes encoding PUFA-PKS polypeptides, and to methods of making and using such microorganisms for producing at least one PUFA. In particular, the disclosure further relates to methods and related materials useful for the production of at least one PUFA by heterologous expression of the nucleic acid sequences disclosed herein encoding PUFA-PKS polypeptides.

12 Claims, 8 Drawing Sheets

Specification includes a Sequence Listing.

(56) References Cited

OTHER PUBLICATIONS

Shulse, et al: "*Widespread Occurrence of Secondary Lipid Biosynthesis Potential in Microbial Lineages;*" PLoS One, May 2011, vol. 6, Iss. 5, p. e20146.
Sugihara, et al.: "*The Escherichia coli Highly Expressed entD Gene Complements the pfaE Deficiency in a pfa Gene Clone Responsibility for the Biosynthesis of Long-Chain n-3 Polyunsaturated Fatty Acids;*" FEMS Microbiology Letters, May 4, 2010, vol. 307, pp. 207-211.
Tavtigian, et al.: "*In Silico Analysis of Missense Substitutions Using Sequence-Alignment Based Methods;*" Human Mutation, Aug. 2008, vol. 29, Iss. 11, pp. 1327-1336.
Wang, et al.: "*Role and Regulation Fatty Acid Biosynthesis in the Response of Shewanella piezotolerans WP3 to Different Temperatures and Pressures;*" J. Bacteriology, Apr. 2009, vol. 191, No. 8, pp. 2574-2584.

*Aliivibrio sp.* SGI-i1612

*Psychromonas arctica* SGI-i1613

*Shewanella sp.* SGI-i1614

*Shewanella sp.* SGI-i1615

MOLECULES ASSOCIATED WITH FATTY ACID BIOSYNTHETIC PATHWAYS AND USES THEREOF

CROSS-REFERENCE TO RELATED APPLICATIONS

This application claims benefit of priority under 35 U.S.C. § 119(e) of U.S. Ser. No. 61/947,317, filed 3 Mar. 2014, the entire contents of which is incorporated herein in its entirety.

FIELD OF THE INVENTION

The present application relates generally to molecular biology and genetic engineering and, more specifically, relates to compositions, methods and related materials that are useful for the production of polyunsaturated fatty acids (PUFAs) by heterologous expression of gene clusters encoding PUFA polyketide synthase (PKS) biosynthetic systems.

INCORPORATION OF SEQUENCE LISTING

The material in the accompanying Sequence Listing is hereby incorporated by reference into this application. The accompanying Sequence Listing text file, named SGI1790_1_Sequence_Listing_ST25, was created on Mar. 2, 2015 and is 1,377,495 KB. The file can be assessed using Microsoft Word on a computer that uses Windows OS.

BACKGROUND OF THE INVENTION

The present disclosure relates in part to isolated or recombinant nucleic acids encoding PUFA-PKS systems, to genetically modified microorganisms comprising such PUFA-PKS systems, and to methods of making and using such microorganisms that include heterologous PUFA-PKS systems.

Polyunsaturated fatty acids, or PUFAs, are fatty acids that contain more than one double bond in their backbone. Long-chain polyunsaturated fatty acids, including those of the omega-3 family, are an essential part of the human diet. They are important constituents of phospholipids that play a role in decreasing membrane rigidity. In particular, eicosapentaenoic acid (EPA) serves as a precursor of prostaglandins and resolvins. Another important PUFA of the omega-3 family is docosahexaenoic acid (DHA). Improved cognitive and behavioral function in infant development seems correlated to high levels of this compound. For omega-3 PUFAs, and in particular for DHA and EPA, beneficial health effects have been shown e.g. the prevention of cancer, rheumatoid arthritis, cardiovascular diseases, the improvement of immune function, and eye and brain health.

Presently, fish oil is the most abundant and widely used natural source for omega-3 fatty acids. Due to problems with overfishing as well as heavy metal contamination of fish stocks, there is a need for an alternative and sustainable source of PUFAs.

Various groups of marine algae have been explored for over 20 years and some products based on algal biomass have meanwhile entered the market. Some oomycetes belonging to the group of stramenopiles were also occasionally reported to produce the above mentioned compounds, e.g. of the genera *Achyla* and *Pythium*. In other stramenopiles, e.g. the genera *Schizochorium* and *Thraustochytrium*, DHA may represent up to 48% of the fatty acid content of the cells, which are the highest contents so far known in the Eukaryota. Other alternative biological sources for omega-3 PUFAs are prokaryotic eubacteria. However, the commercial exploitation of these organisms for PUFA production on an industrial scale is hampered by the slow growth characteristics of these psychrophilic bacteria, as well as their inherently low yields and productivity.

It has been established that PUFAs are biosynthesized in a similar manner as the polyketide secondary metabolites in both prokaryotic and eukaryotic organisms. Gene clusters encoding synthetic pathway enzymes for biosynthesis of omega-3 PUFAs have been documented for various marine bacteria, including species of the genera *Moritella*, *Photobacterium*, and *Shewanella*. Heterologous expression of a polyketide synthase gene cluster from *Shewanella oneidensis* MR-1 is reported to result in the production of EPA in *E. coli* cultured at 15° C. (Lee et al. *Biotech. Bioproc. Eng.* 11, 510-515, 2006). DHA has been synthesized by *E. coli* by expression of a gene cluster from *Moritella marina* MP-1 (Orikasa et al. *Biotechnol. Lett.* 28, 1841-1847, 2006).

SUMMARY OF THE INVENTION

Methods and materials useful for producing a polyunsaturated fatty acid (PUFA) are disclosed. For example, disclosed herein are recombinant microorganisms that include non-native PKS genes, such as PKS genes from prokaryotic microorganisms, for the production of at least one PUFA, such as DHA or EPA. Provided herein are nucleic acid molecules encoding PUFA-PKS enzymatic activities, as well as methods for using such nucleic acid molecules to transform microbial cells, including eukaryotic microorganisms such as members of the labyrinthulomycetes, to modulate the production of at least one PUFA in the host cells. Methods of producing a PUFA using the transgenic microorganisms provided herein are also included.

In one aspect, provided herein are recombinant microorganisms genetically engineered to include at least one non-native gene encoding a polypeptide of a PUFA-PKS system, such as for example, a pfaA, pfaB, pfaC, pfaD, or pfaE polypeptide. The PUFA-PKS system can be a prokaryotic PUFA-PKS system, for example, a PUFA-PKS system derived from a genus such as but not limited to *Aliivibrio, Colwellia, Shewanella, Labyrinthuloides, Moritella, Photobacterium, Pseudoaltermonas, Psychromonas,* and *Vibrio*. The host microorganism can be a eukaryotic microorganism, and in certain examples may be a species of the labyrinthylomycetes class. The host microorganism can include a prokaryotic PKS system such as, but not limited to, any disclosed herein, and can produce an increased amount of DHA and/or EPA with respect to a control microorganism. For example, a recombinant microorganism as disclosed herein that includes at least one non-native gene encoding at least one polypeptide of a prokaryotic PUFA-PKS system can produce at least 20%, at least 30%, at least 40%, at least 50%, at least 60%, at least 70%, at least 80%, at least 90%, at least 100%, at least 150%, or at least 200% more of DHA or EPA than is produced by a control microorganism over a period of at least eight, twelve, sixteen, twenty-four, or forty-eight hours of culture. The culture can be incubated at a temperature of greater than 15° C., for example, at a temperature of at least 20° C., at least 25° C., or at least 30° C.

Thus, provided herein are methods of producing at least one PUFA by culturing a recombinant microorganism, such as a eukaryotic microorganism, that includes at least one non-native gene encoding a polypeptide of a prokaryotic PUFA-PKS system or a derivative thereof having at least 65%, at least 70%, at least 75%, at least 80%, at least 85%, at least 90% or at least 95% amino acid identity thereto, in which the recombinant microorganism produces more of at least one PUFA than is produced by a control microorganism that does not include a non-native gene encoding a polypeptide of a prokaryotic PUFA-PKS system or a derivative thereof. For example, the methods can include producing at least 20%, at least 30%, at least 40%, at least 50%, at least 60%, at least 70%, at least 80%, at least 90%, at least 100%, at least 150%, or at least 200% more of DHA or EPA than is produced by a control microorganism over a period of at least eight, twelve, sixteen, twenty-four, or forty-eight hours of culture. The methods can include culturing the microorganism at a temperature of greater than 15° C., for example, at a temperature of at least 20° C. at least 25° C., or at least 30° C., for example, at a temperature of between 16° C. and about 20° C., between about 20° C. and about 25° C., between about 25° C. and about 30° C., at about 30° C., or between about 30° C. and about 35° C. The methods can further include recovering at least one PUFA from the culture. The one or more PUFAs can be recovered in a lipid composition that comprises the one or more PUFAs, for example, as components of triglycerides, diglycerides, monoglycerides, phospholipids, sphingolipids, galactolipids, free fatty acids, or any mixture thereof. In various examples the recombinant eukaryotic microorganism used for the production of at least one PUFA is a labyrinthulomycete.

A eukaryotic host microorganism engineered for PUFA production can be a labyrinthulomycetes species, such as, for example, a species of a genus such as but not limited to *Aurantiochytrium*, *Oblongichytrium*, *Schizochytrium*, *Thraustochytrium*, or *Ulkenia*. In various examples, the host microorganism is a eukaryotic microorganism that includes a non-native pfaA, pfaB, pfaC, pfaD, and/or pfaE gene derived from a prokaryotic species where the nucleotide sequence encoding the pfaA, pfaB, pfaC, pfaD, and/or pfaE gene is operably linked to a regulatory sequence, such as a eukaryotic promoter. The eukaryotic promoter can be a eukaryotic promoter that can direct expression of the prokaryotic pfaA, pfaB, pfaC, pfaD, and/or pfaE gene in the eukaryotic host. For example, a recombinant labyrinthulomycete can include a non-native gene encoding a PUFA-PKS polypeptide (e.g., a pfaA, pfaB, pfaC, pfaD, or pfaE polypeptide) operably linked to a promoter derived from a labyrinthulomycetes species. In various examples, the nucleotide sequence encoding a polypeptide of a PUFA-PKS system is optimized for expression in the eukaryotic host, e.g., one or more codons of the gene encoding the PUFA-PKS polypeptide may be altered with respect to the naturally-occurring gene.

Also provided herein are isolated, synthetic, or recombinant nucleic acid molecules that include a nucleic acid sequence encoding a polypeptide exhibiting at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:2, SEQ ID NO:4, SEQ ID NO:6, SEQ ID NO:8, SEQ ID NO:10, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, and SEQ ID NO:150; and fragments of these amino acid sequences. The nucleic acid molecules can include a heterologous promoter sequence operably linked to the polypeptide-encoding sequence and/or the nucleic acid molecule can comprise a vector.

In various embodiments, the isolated and recombinant nucleic acid molecules provided herein encode polypeptides that include at least one polyunsaturated fatty acid (PUFA) synthase activity selected from the group consisting of acyl carrier protein (ACP) activity, acyl transferase (AT) activity, chain-length factor (CLF) activity, beta-hydroxyacyl-ACP dehydrase (DH) activity, enoyl reductase (ER) activity, ketoreductase (KR) activity, beta-keto acyl-ACP synthase (KS) activity, malonyl-CoA:ACP acyltransferase (MAT) activity, phosphopantetheinyl transferase (PPTase) activity, and any combinations thereof.

In some examples, an isolated, synthetic, or recombinant nucleic acid molecule can include a nucleic acid sequence encoding a pfaA polypeptide of a PUFA-PKS system and can have, for example, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:2, SEQ ID NO:18, SEQ ID NO:28, SEQ ID NO:38, SEQ ID NO:48, SEQ ID NO:58, SEQ ID NO:68, SEQ ID NO:78, SEQ ID NO:88, SEQ ID NO:98, SEQ ID NO:108, SEQ ID NO:110, SEQ ID NO:120, SEQ ID NO:130, SEQ ID NO:132, and SEQ ID NO:142. In some examples, an isolated, synthetic, or recombinant nucleic acid molecule can include a nucleic acid sequence encoding a pfaA polypeptide of a PUFA-PKS system and can have, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:2, SEQ ID NO:18, and SEQ ID NO:38.

In other examples, an isolated, synthetic, or recombinant nucleic acid molecule can include a nucleic acid sequence encoding a pfaB polypeptide of a PUFA-PKS system and can have, for example, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:4, SEQ ID NO:20, SEQ ID NO:30, SEQ ID NO:40, SEQ ID NO:50, SEQ ID NO:60, SEQ ID NO:70, SEQ ID NO:80, SEQ ID NO:90, SEQ ID NO:100, SEQ ID NO:112, SEQ ID NO:122, SEQ ID NO:134, and SEQ ID NO:144. In some examples, an isolated, synthetic, or recombinant nucleic acid molecule can include a nucleic acid sequence encoding a pfaB polypeptide of a PUFA-PKS system and can have, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:4, SEQ ID NO:20, and SEQ ID NO:40.

In additional examples, an isolated, synthetic, or recombinant nucleic acid molecule can include a nucleic acid sequence encoding a pfaC polypeptide of a PUFA-PKS system and can have, for example, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:6, SEQ ID NO:22, SEQ ID NO:32, SEQ ID NO:42, SEQ ID NO:54, SEQ ID NO:62, SEQ ID NO:72, SEQ ID NO:82, SEQ ID NO:92, SEQ ID NO:102, SEQ ID NO:114, SEQ ID NO:124, SEQ ID NO:136, and SEQ ID NO:146. In some examples, an isolated, synthetic, or recombinant nucleic acid molecule can include a nucleic acid sequence encoding a pfaC polypeptide of a PUFA-PKS system and can have, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:6, SEQ ID NO:22, and SEQ ID NO:42.

In further examples, an isolated, synthetic, or recombinant nucleic acid molecule can include a nucleic acid sequence encoding a pfaD polypeptide of a PUFA-PKS system and can have, for example, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:8, SEQ ID NO:24, SEQ ID NO:34, SEQ ID NO:44, SEQ ID NO:54, SEQ ID NO:64, SEQ ID NO:74, SEQ ID NO:84, SEQ ID NO:94, SEQ ID NO:104, SEQ ID NO:116, SEQ ID NO:126, SEQ ID NO:138, and SEQ ID NO:148. In some examples, an isolated, synthetic, or recombinant nucleic acid molecule can include a nucleic acid sequence encoding a pfaD polypeptide of a PUFA-PKS system and can have at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:8, SEQ ID NO:24, and SEQ ID NO:44.

In yet other examples, an isolated, synthetic, or recombinant nucleic acid molecule can include a nucleic acid sequence encoding a pfaE polypeptide of a PUFA-PKS system and can have, for example, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:10, SEQ ID NO:26, SEQ ID NO:36, SEQ ID NO:46, SEQ ID NO:56, SEQ ID NO:66, SEQ ID NO:76, SEQ ID NO:86, SEQ ID NO:96, SEQ ID NO:106, SEQ ID NO:118, SEQ ID NO:128, SEQ ID NO:140, and SEQ ID NO:150. In some examples, an isolated, synthetic, or recombinant nucleic acid molecule can include a nucleic acid sequence encoding a pfaE polypeptide of a PUFA-PKS system and can have at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:10, SEQ ID NO:26, and SEQ ID NO:46.

In various examples, a recombinant microorganism as provided herein can include at least one non-native gene encoding a pfaA gene of a PUFA-PKS system, at least one non-native gene encoding a pfaB gene of a PUFA-PKS system, at least one non-native gene encoding a pfaC gene of a PUFA-PKS system, at least one non-native gene encoding a pfaD gene of a PUFA-PKS system, and at least one non-native gene encoding a pfaE gene of a PUFA-PKS system. The recombinant microorganism can be a eukaryotic microorganism, such as, for example, a labyrinthulomycetes microorganism. The pfaA, pfaB, pfaC, pfaD, and pfaE genes can be derived from a prokaryotic microorganism, and can be from the same or different prokaryotic species. The genes can be operably linked to promoters derived from a eukaryotic microorganism, such as but not limited to a labyrinthulomycetes microorganism. The recombinant eukaryotic microorganism can produce an increased amount of at least one PUFA, such as an omega-3 PUFA, e.g., DHA and/or EPA. In some examples, the recombinant eukaryotic microorganism can produce an increased amount of at least one PUFA, such as an omega-3 PUFA, e.g., DHA and/or EPA, when cultured at a temperature of greater than 15° C., for example, at a temperature of at least 20° C., at least 25° C., or at least 30° C.

Alternatively or in addition, the isolated or recombinant nucleic acid molecules according to this aspect can include a nucleic acid sequence exhibiting at least 50%, at least 55%, at least 60%, at least 65%, at least 70%, at least 75%, at least 80%, at least 85%, at least 90%, at least 95%, at least 96%, at least 97%, at least 98%, or at least 99% identity to at least 500 successive nucleotides of a nucleic acid sequence selected from the group consisting of SEQ ID NO:1, SEQ ID NO:3, SEQ ID NO:5, SEQ ID NO:7, SEQ ID NO:9, SEQ ID NO:11, SEQ ID NO:12, SEQ ID NO:13, SEQ ID NO:14, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, and SEQ ID NO:149; and complements of said nucleic acid sequences; and fragments of either. In some embodiments, the isolated or recombinant nucleic acid molecules according to this aspect can, alternatively or in addition, include a nucleic acid sequence encoding a polypeptide exhibiting at least 65%, at least 70%, at least 75%, at least 80%, at least 85%, at least 90%, at least 95%, at least 96%, at least 97%, at least 98%, or at least 99% identity to at least 500 successive amino acids of an amino acid sequence selected from the group consisting of SEQ ID NO:2, SEQ ID NO:4, SEQ ID NO:6, SEQ ID NO:8, SEQ ID NO:10, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, and SEQ ID NO:150; and fragments of said amino acid sequences.

The isolated or recombinant nucleic acid molecules provided herein can, in some examples, have nucleotide sequences that are different from (i.e., not 100% identical to) a nucleotide sequence of a naturally-occurring gene. Further, an isolated or recombinant nucleic acid molecule as disclosed herein, when expressed in a recombinant host cell, can confer modulated production of at least one PUFA in the host cell. In some embodiments, the isolated or recombinant nucleic acid molecules provided herein can be operably linked to a heterologous nucleic acid and alternatively or in addition a nucleic acid molecule as disclosed herein can comprise vector. For example, the isolated or recombinant nucleic acid molecules provided herein can be recombinant nucleic acid constructs comprising a nucleic acid sequence such as any disclosed herein encoding at least one polypeptide of a prokaryotic PUFA-PKS system and further including a nucleic acid sequence heterologous with respect to the PUF-PKS polypeptide-encoding sequence. In some preferred embodiments, the heterologous nucleic acid sequence is a heterologous regulatory element, which in turn can be a transcriptional regulatory element or a translational regulatory element. In some preferred embodiments, the heterologous regulatory element is a heterologous promoter operably linked to the PUF-PKS polypeptide-encoding sequence. Promoters considered for use in the invention include any promoters functional in the host microorganism and without limitation include promoters isolated from or active in labyrinthulomycetes species, including without limitation the chytrid promoters of TABLE 1 (SEQ ID NO:16, SEQ ID NO:151, and SEQ ID NO:175-242), sequence variants thereof, and functional fragments thereof.

In one aspect, provided herein are a recombinant host cell that includes an isolated or recombinant nucleic acid molecule according to any one of the preceding aspects and embodiments. In some embodiments, the host cell expresses any one of the foregoing nucleic acid molecules. In some embodiments, expression of the recombinant nucleic acid molecule in the recombinant host cell results in modulated production of at least one PUFA in the host cell. In some particular embodiments, the recombinant host cell provided herein can be a microbial cell. For example, the recombinant host cell may be a bacterium, a cyanobacterium, or a eukaryotic microbial cell such as, for example, a stramenopile or a fungus. In some preferred embodiments, the microbial cell is of a eukaryotic microorganism belonging to the labyrinthulomycetes class. For example, the microorganism can be a species of *Aurantiochytrium, Oblongichytrium, Schizochytrium,* or *Thraustochytrium,* or *Ulkenia*.

Further provided herein, in one aspect, are methods for producing at least one PUFA. The method includes culturing a recombinant eukaryotic microorganism as provided herein that includes at least one non-native gene encoding a pfaA, pfaB, pfaC, pfaD, or pfaE gene of a PUFA-PKS system to produce a PUFA. In some embodiments the PUFA is EPA.

In various examples the recombinant eukaryotic microorganism is a species of the labyrinthulomycetes class. In various examples, the recombinant eukaryotic microorganism includes a non-native gene encoding a pfaA polypeptide, a non-native gene encoding a pfaB polypeptide, a non-native gene encoding a pfaC polypeptide, a non-native gene encoding a pfaD polypeptide, and a non-native gene encoding a pfaE polypeptide derived from one or more prokaryotic microorganisms. The sequences encoding PUFA-PKS polypeptides can be operably linked to labyrinthulomycetes promoters, such as any disclosed in TABLE 1, active fragments thereof, or promoters that include sequences having at least 90% identity thereto. In various examples the culturing is at a temperature greater than greater than 15° C., for example, at a temperature of at least 20° C., at least 25° C., or at least 30° C. The recombinant eukaryotic microorganism can produce an increased amount of at least one PUFA with respect to a control microorganism that does not include at least one non-native gene encoding a pfaA, pfaB, pfaC, pfaD, or pfaE gene of a PUFA-PKS system.

In some preferred embodiments, the at least one PUFA can be an omega-3 PUFA, for example, docosahexaenoic acid (DHA) or eicosapentaenoic acid (EPA). A PUFA produced using the methods provided herein can be recovered from a microbial culture as a lipid or oil that includes, for example, one or more phospholipids and/or glycerolipids that includes the PUFA.

In yet another aspect, provided herein is a method for modulating the production of at least one PUFA. The method includes (a) providing a nucleic acid molecule according to any one of the preceding aspects and embodiments, and (b) introducing the nucleic acid molecule into a host cell to generate a transformed host cell, wherein the presence of the nucleic acid molecule in the transformed host cell confers modulated production of the at least one PUFA. In some embodiments, the expression of the foregoing nucleic acid molecule in the transformed host cell confers modulated production of the at least one PUFA. In some preferred embodiments, the at least one PUFA can be an omega-3 PUFA. In some particularly preferred embodiments, the at least one PUFA can be docosahexaenoic acid (DHA), or eicosapentaenoic acid (EPA).

These and other objects and features of the invention will become more fully apparent from the following detailed description of the invention and the claims.

SGI-i594, bacterial isolate SGI-i1605, bacterial isolate SGI-1607, *Vibrio* sp. SGI-i1609, *Vibrio* sp. SGI-i1610, *Vibrio gigantis* SGI-i1611, *Aliivibrio* sp. SGI-i1612, *Psychromonas arctica* SGI-i1613, *Shewanella* sp. SGI-i1614, and *Shewanella* sp. SGI-i1615. Gray boxes and black boxes identify coding sequences and conserved polypeptide domains that have been identified from in silico sequence comparison analyses. Amino acid residues corresponding to the conserved domains of each of the PUFA-PKS polypeptides disclosed herein are indicated in the Sequence Listing. Abbreviations: AT, acyl coA:ACP transferase; ACP, acyl carrier protein; CLF, chain length factor; DH, β-hydroxyacyl-ACP dehydrase or isomerase; ER, enoyl reductase; KR, ketoacyl reductase; KS, β-ketoacyl-ACP synthase; MAT, malonyl-CoA:ACP acyltransferase; PPTase, phosphopantetheinyl transferase; TR, thioester reductase.

Figure 3:
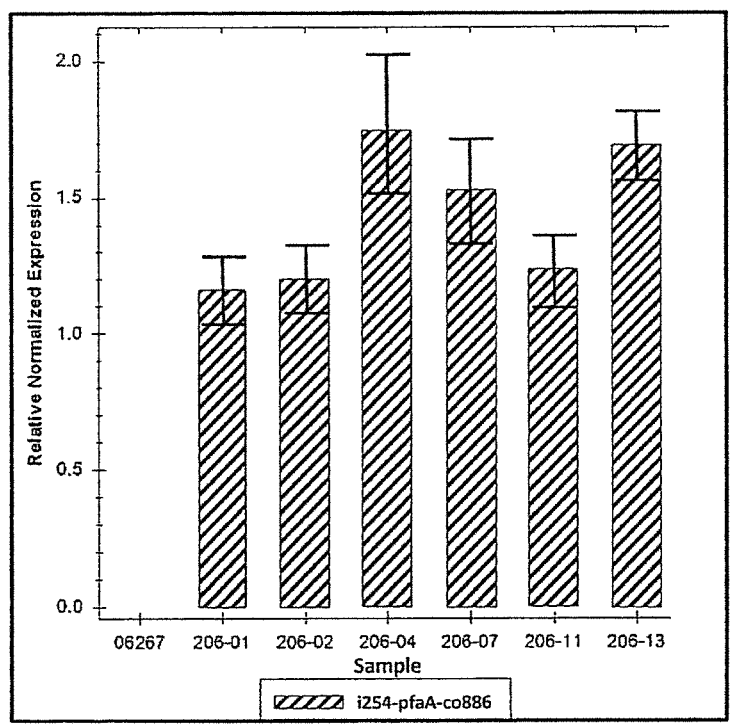

FIG. 3 illustrates the results of experiments assessing steady-state mRNA levels of the codon-optimized i254-pfaA-co886 transgene in six independent recombinant chytrid lines and the untransformed parent line (WH-SGI-F-06267). Cells were grown under standard conditions and harvested during mid-growth phase. Normalized expression values are plotted on the y-axis relative to wild type (WH-SGI-F-06267). Normalization was calculated against a house keeping gene, SG2EUKT116641). Error bars represent the standard error for 3 technical replicates.

Figure 4:
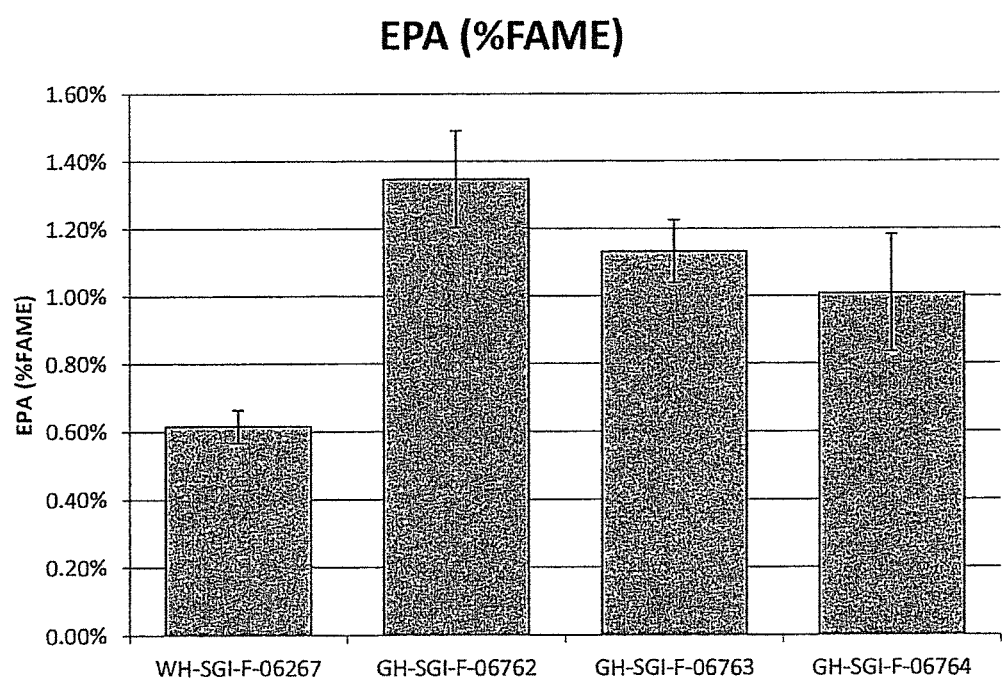

FIG. 4 illustrates the results of experiments assessing fatty acid accumulation level of the recombinant chytrid cell lines. The graphs represent the amounts of eicosapentaenoic acid (EPA) relative to total fatty acid methyl esters (FAME) produced in overnight cultures of three recombinant chytrid cells and wild-type control. WH-SGI-F-06267 was a wild-type control strain. GH-SGI-F-06762, GH-SGI-F-06763, and GH-SGI-F-06764 are three recombinant chytrid strains that each carries the entire codon-optimized PUFA-PKS pathway from the bacterial isolate SGI-i254, as described in detail at Example 6.

DETAILED DESCRIPTION OF THE INVENTION

The present disclosure relates in part to isolated or recombinant molecules associated with polyunsaturated fatty acid (PUFA) biosynthetic pathways in various prokaryotic microorganisms and to recombinant microorganisms, such as recombinant eukaryotic microorganisms, that include non-native genes of prokaryotic PUFA PKA systems. The disclosure also relates to methods of making and uses such recombinant microorganisms for the production of at least one PUFA.

Some Definitions

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art.

The singular form "a", "an", and "the" include plural references unless the context clearly dictates otherwise. For example, the term "a cell" includes one or more cells, including mixtures thereof. "A and/or B" is used herein to include all of the following alternatives: "A", "B", and "A and B".

"About" means plus or minus 10% of the provided value. Where ranges are provided, they are inclusive of the boundary values.

As used herein, "allele" refers to one of two or more alternative forms or alternative conditions of a gene occupying corresponding sites (loci) on homologous chromosomes. Typically, the DNA sequence of alleles of a locus differs from each other by at least one nucleotide.

As used herein, "amino acid" refers to naturally-occurring and synthetic amino acids, as well as amino acid analogs and amino acid mimetics that function in a manner similar to the naturally-occurring amino acids. Naturally-occurring amino acids are those encoded by the genetic code, including D/L optical isomers, as well as those amino acids that are later modified, e.g., hydroxyproline, y-carboxyglutamate, and O-phosphoserine. Amino acid analogs refer to compounds that have the same basic chemical structure as a naturally-occurring amino acid, i.e., a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally-occurring amino acid. Amino acid mimetics, as used herein, refer to chemical compounds that have a structure that is different from the general chemical structure of an amino acid, but that functions in a manner similar to a naturally-occurring amino acid.

A "cDNA" is a DNA molecule that comprises at least a portion the nucleotide sequence of an mRNA molecule, with the exception that the DNA molecule substitutes the nucleobase thymine, or T, in place of uridine, or U, occurring in the mRNA sequence. A cDNA can be single-stranded or double-stranded, and can be the complement of the mRNA sequence. In preferred embodiments, a cDNA does not include one or more intron sequences that occur in the naturally-occurring gene (in the genome of an organism) that the cDNA corresponds to. For example, a cDNA can have sequences from upstream of an intron of a naturally-occurring gene juxtaposed to sequences downstream of the intron of the naturally-occurring gene, where the upstream and downstream sequences are not juxtaposed in a DNA molecule (i.e., the naturally occurring gene) in nature. A cDNA can be produced by reverse transcription of mRNA molecules, or can be synthesized, for example, by chemical synthesis and/or by using one or more restriction enzymes, one or more ligases, one or more polymerases (including, but not limited to, high temperature tolerant polymerases that can be used in polymerase chain reactions (PCRs)), one or more recombinases, etc., based on knowledge of the cDNA sequence, where the knowledge of the cDNA sequence can optionally be based on the identification of coding regions from genome sequences or compiled from the sequences of multiple partial cDNAs.

A "coding sequence" or "coding region", as used herein in reference to an mRNA or DNA molecule, refers to the portion of the mRNA or DNA molecule that codes for a polypeptide. It typically consists of the nucleotide residues of the molecule which are matched with an anticodon region of a transfer RNA molecule during translation of the mRNA molecule or which encode a stop codon. The coding sequence may thus include nucleotide residues corresponding to amino acid residues which are not present in the mature protein encoded by the mRNA molecule (e.g., amino acid residues in a protein export signal sequence).

A "control organism", "control microorganism", or "control cell" as used in the present disclosure provides a reference point for measuring changes in phenotype of the subject organism, microorganism, or cell. A control organism, microorganism, or cell may comprise, for example, (a) a wild-type organism, microorganism, or cell, i.e., of the same genotype as the starting material for the genetic alteration which resulted in the subject organism, microorganism, or cell; (b) an organism, microorganism, or cell of the same genotype as the starting material but which has been transformed with a null construct (i.e. a construct which has no known effect on the trait of interest, such as a construct comprising a reporter gene); (c) an organism, microorganism, or cell which is a non-transformed segregant among progeny of a subject organism, microorganism, or cell; or (d) the subject organism, microorganism, or cell itself, under conditions in which the gene of interest is not expressed. In some instances, "control organism" may refer to an organism that does not contain the exogenous nucleic acid present in the transgenic organism of interest, but otherwise has the same or similar genetic background as such a transgenic organism.

A nucleic acid molecule may be "derived from" an indicated source, which includes the isolation (in whole or in part) of a nucleic acid segment from an indicated source. A nucleic acid molecule may also be derived from an indicated source by, for example, direct cloning, PCR amplification, or artificial synthesis from the indicated polynucleotide source or based on a sequence associated with the indicated polynucleotide source. Genes or nucleic acid molecules derived from a particular source or species also include genes or nucleic acid molecules having sequence modifications with respect to the source nucleic acid molecules. For example, a gene or nucleic acid molecule derived from a source (e.g., a particular referenced gene) can include one or more mutations with respect to the source gene or nucleic acid molecule that are unintended or that are deliberately introduced, and if one or more mutations, including substitutions, deletions, or insertions, are deliberately introduced the sequence alterations can be introduced by random or targeted mutation of cells or nucleic acids, by amplification or other molecular biology techniques, or by chemical synthesis, or any combination thereof. A gene or nucleic acid molecule that is derived from a referenced gene or nucleic acid molecule that encodes a functional RNA or polypeptide can encode a functional RNA or polypeptide having at least 75%, at least 80%, at least 85%, at least 90%, or at least 95%, sequence identity with the referenced or source functional RNA or polypeptide, or to a functional fragment thereof. For example, a gene or nucleic acid molecule that is derived from a referenced gene or nucleic acid molecule that encodes a functional RNA or polypeptide can encode a functional RNA or polypeptide having at least 85%, at least 90%, at least 95%, at least 96%, at least 97%, at least 98%, or at least 99% sequence identity with the referenced or source functional RNA or polypeptide, or to a functional fragment thereof.

"Domains" are groups of substantially contiguous amino acids in a polypeptide that can be used to characterize protein families and/or parts of proteins. Such domains typically have a "fingerprint", "motif", or "signature" that can comprise conserved primary sequence, secondary structure, and/or three-dimensional conformation. Generally, domains are correlated with specific in vitro and/or in vivo activities. A domain can have a length of from 4 amino acids to 400 amino acids, e.g., 4 to 50 amino acids, or 4 to 20 amino acids, or 4 to 10 amino acids, or 4 to 8 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, biological activity, or combinations of any thereof) relative to basal or native states.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting there from. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

The term "endogenous," within the context of the present disclosure refers to any polynucleotide, polypeptide or protein sequence which is a natural part of a cell or organism.

"Exogenous" with respect to a nucleic acid or gene indicates that the nucleic or gene has been introduced ("transformed") into an organism, microorganism, or cell by human intervention. Typically, such an exogenous nucleic acid is introduced into a cell or organism via a recombinant nucleic acid construct. An exogenous nucleic acid can be a sequence from one species introduced into another species, i.e., a heterologous nucleic acid. An exogenous nucleic acid can also be a sequence that is homologous to an organism (i.e., the nucleic acid sequence occurs naturally in that species or encodes a polypeptide that occurs naturally in the host species) that has been reintroduced into cells of that organism. An exogenous nucleic acid that includes a homologous sequence can often be distinguished from the naturally-occurring sequence by the presence of non-natural sequences linked to the exogenous nucleic acid, e.g., non-native regulatory sequences flanking the homologous gene sequence in a recombinant nucleic acid construct. Alternatively or in addition, a stably transformed exogenous nucleic acid can be detected and/or distinguished from a native gene by its juxtaposition to sequences in the genome where it has integrated. An nucleic acid is considered exogenous if it has been introduced into a progenitor of the cell, organism, or strain under consideration As used herein, "expression" refers to the process of converting genetic information of a polynucleotide into RNA through transcription, which is typically catalyzed by an enzyme, RNA polymerase, and, where the RNA encodes a polypeptide, into protein, through translation of mRNA on ribosomes to produce the encoded protein.

"Fragment", with respect to a polynucleotide, refers to a clone or any part of a polynucleotide molecule, particularly a part of a polynucleotide that retains a usable, functional characteristic. Useful fragments include oligonucleotides and polynucleotides that may be used in hybridization or amplification technologies or in the regulation of replication, transcription or translation. A "polynucleotide fragment" refers to any subsequence of a polynucleotide, typically, of at least about 9 consecutive nucleotides, for example at least about 30 nucleotides or at least about 50 nucleotides of any of the sequences provided herein. Exemplary polynucleotide fragments are the first sixty consecutive nucleotides of the polynucleotides listed in the Sequence Listing. Exemplary fragments also include fragments that comprise a region that encodes a conserved PUFA-PKS activity of a polypeptide. Exemplary fragments also include fragments that comprise a conserved structural domain/motif of a polypeptide.

Fragments may also include subsequences of polypeptides and protein molecules, or a subsequence of the polypeptide. Fragments of the disclosed herein molecules may have several uses in, for examples, the construction of chimeric PUFA-PKS systems. Fragments may also have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as 3 amino acid residues to the full length of the intact polypeptide, for example at least about 20 amino acid residues in length, for example at least about 30 amino acid residues in length.

The term "functional homolog" as used herein describes those proteins that have at least one characteristic in common. Such characteristics include sequence similarity, biochemical activity, transcriptional pattern similarity and phenotypic activity. Typically, a functional homolog is a polypeptide that has sequence similarity to a reference polypeptide, and that carries out one or more of the biochemical or physiological function(s) of the reference polypeptide. Functional homologs will typically give rise to the same characteristics to a similar, but not necessarily the same, degree. Functionally homologous proteins give the same characteristics where the quantitative measurement produced by one homolog is at least 10% of the other; more typically, at least 20%, between about 30% and about 40%; for example, between about 50% and about 60%; between about 70% and about 80%; or between about 90% and about 95%; between about 98% and about 100%, or greater than 100% of that produced by the original molecule. Thus, where the molecule has enzymatic activity, e.g. for example PKS synthase activity, the functional homolog will have the above-recited percent enzymatic activities compared to the original enzyme.

A functional homolog and the reference polypeptide may be naturally occurring polypeptides, and the sequence similarity may be due to convergent or divergent evolutionary events. As such, functional homologs are sometimes designated in the literature as homologs, orthologs, or paralogs.

Variants of a naturally-occurring functional homolog, such as polypeptides encoded by mutants or a wild-type coding sequence, may themselves be functional homologs. As used herein, functional homologs can also be created via site-directed mutagenesis of the coding sequence for a PUFA-PKS polypeptide, or by combining domains from the coding sequences for different naturally-occurring PUFA-PKS polypeptides. The term "functional homolog" sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of PUFA-PKS polypeptides. Sequence analysis can involve BLAST, Reciprocal BLAST, or PSI-BLAST analysis of non-redundant databases using amino acid sequence of a PUFA-PKS polypeptide as the reference sequence. Amino acid sequence is, in some instances, deduced from the nucleotide sequence. Typically, those polypeptides in the database that have greater than 40% sequence identity are candidates for further evaluation for suitability as a PUFA-PKS polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in PUFA-PKS polypeptides, e.g., conserved functional domains.

Conserved regions can be identified by locating a region within the primary amino acid sequence of a PUFA-PKS polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. A description of the information included at the Pfam database is described in, for example, Sonnhammer et al. (*Nucl. Acids Res.*, 26:320-322, 1998), Sonnhammer et al. (*Proteins*, 28:405-420, 1997); and Bateman et al. (*Nucl. Acids Res.*, 27:260-262, 1999). Conserved regions also can be determined by aligning sequences of the same or related polypeptides from closely related species. Closely related species preferably are from the same family. In some embodiments, alignment of sequences from two different species is adequate. Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity. Examples of domains indicative of PUFA-PKS synthase activity have been previously described in several microbial species, including bacterial species and microorganism belonging to the order Thraustochytriales (see, e.g. Metz et al. *Science* 293: 290-293, 2001; U.S. Pat. Nos. 7,247,461; 7,368,552; 7,799,564; 7,803,620; US. Pat. Appl. Nos. US20030101486A1, US20100266564A1, US20130196391A1; all of which are incorporated herein by reference).

When used in reference to a polynucleotide, a gene, a nucleic acid, a polypeptide, or an enzyme, the term "heterologous" refers to a polynucleotide, gene, a nucleic acid, polypeptide, or an enzyme not derived from the host species, e.g., is from a different species with respect to the host cell. For example, a transgenic *Schizochytrium* microorganism transformed with the coding sequence for a fatty acid synthase from a *Vibrio* sp. microorganism or from a *Shewanella* sp. microorganism is transformed with a heterologous fatty acid synthase gene. When referring to nucleic acid sequences operably linked or otherwise joined to one another in a nucleic acid construct or molecule, "heterologous sequences", as used herein, are those that are not operably linked or are not contiguous to each other in nature. For example, a promoter from *Schizochytrium* sp. is considered heterologous to a *Thraustochytrium* coding region sequence. Also, a promoter from a gene encoding a beta-tubulin gene from *Schizochytrium* is considered heterologous to a sequence encoding a *Schizochytrium* fatty acid synthase. Similarly, when referring to a gene regulatory sequence or to an auxiliary nucleic acid sequence used for maintaining or manipulating a gene sequence (e.g., a promoter, enhancer, 5' untranslated region, 3' untranslated region, Kozak sequence, poly A addition sequence, intron sequence, splice site, ribosome binding site, internal ribosome entry sequence, genome homology region, recombination site, etc.), "heterologous" means that the regulatory sequence or auxiliary sequence is from a different source (e.g., different gene, whether from the same or different species as the host organisms) than the gene with which the regulatory or auxiliary nucleic acid sequence is juxtaposed in a construct, genome, chromosome, or episome. When referring to a protein functional domain, such as a PUFA-PKS synthase domain or a receptor binding site, "heterologous" can also mean that the protein functional domain is from a different source (e.g., protein) than the rest of the protein region with which it is juxtaposed in an engineered protein. Similarly, when referring to a promoter sequence of an engineered gene, "heterologous" means that the promoter is derived from a different gene than that to which it is linked by genetic engineering. As such, elements operably linked in nature and contiguous to each other are not heterologous to each other. On the other hand, these same elements remain operably linked but become heterologous if other filler sequence is placed between them. Thus, the promoter and coding sequences of a *Schizochytrium* gene expressing fatty acid synthase are not heterologous to each other, but the promoter and coding sequence of a *Schizochytrium* gene operably linked in a novel manner, e.g. with human intervention, are heterologous.

As used herein, an "isolated" nucleic acid or protein is removed from its natural milieu or the context in which the nucleic acid or protein exists in nature. For example, an isolated protein or nucleic acid molecule is removed from the cell or organism with which it is associated in its native or natural environment. An isolated nucleic acid or protein can be, in some instances, partially or substantially purified, but no particular level of purification is required for isolation. For nucleic acids, an "isolated" nucleic acid preferably is free of sequences that naturally flank the nucleic acid (i.e., sequences located at the 5' and 3' ends of the nucleic acid) in the cell of the organism from which the nucleic acid is derived. Thus, "isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid. For purposes of the invention, the term "isolated" when used to refer to nucleic acid molecules also excludes isolated chromosomes. Thus, for example, an isolated nucleic acid molecule can be a nucleic acid sequence that has been excised from the chromosome, genome, or episome that it is integrated into in nature.

A "purified" nucleic acid molecule or nucleotide sequence, or protein or polypeptide sequence, is substantially free of cellular material and cellular components. The purified nucleic acid molecule or protein may be free of chemicals beyond buffer or solvent, for example. The term "substantially purified", as used herein, refers to a molecule separated from substantially all other molecules normally associated with it in its native state. More preferably a substantially purified molecule is the predominant species present in a preparation that is, or results, however indirect, from human manipulation of a polynucleotide or polypeptide. A substantially purified molecule may be greater than 90% free, preferably 95% free, more preferably 96% free, and most preferably 98% free from the other molecules (exclusive of solvent) present in the natural mixture. The term "substantially purified" is not intended to encompass molecules present in their native state.

Similarly, "substantially free" is not intended to mean that other components beyond the novel nucleic acid molecules are undetectable. In some circumstances "substantially free" may mean that the nucleic acid molecule or nucleotide sequence is free of at least 95% (w/w) of cellular material and components.

The term "mis-expression" refers to an increase or decrease in the transcription of a coding region into a complementary RNA sequence as compared to the parental wild-type, for example, plant or microorganism. This term also encompasses expression of a gene or coding region for a different time period as compared to the wild-type and/or from a non-natural location within the parental genome. The term "overexpression" or "increased expression" as used herein refers to a greater expression level of a gene, a polynucleotide sequence, or a polypeptide, in a host cell compared to a wild-type cell or a wild-type organism, at any developmental or temporal stage. Methods for increasing expression of genes or gene products are well documented in the art and include, for example, overexpression driven by appropriate promoters (e.g. constitutive promoters), the use of transcription enhancers or translation enhancers. Overexpression may also under control of an inducible or a growth-phase specific promoter. For example, overexpression may occur throughout a microbial cell, in specific growth phases of the microbe, or in the presence or absence of particular environmental signals, depending on the promoter used.

"Modulation" of the production of a fatty acid, as used herein, refers to the change in the level of the production that is observed as a result of presence of, expression of, or transcription from, an exogenous nucleic acid in a cell or an organism. The change in level is typically measured relative to the corresponding level in control cell or organism.

The term "native" is used herein to refer to nucleic acid sequences or amino acid sequences as they naturally occur in the host. The term "non-native" is used herein to refer to nucleic acid sequences or amino acid sequences that do not occur naturally in the host, or are not configured as they are naturally configured in the host. A nucleic acid sequence or amino acid sequence that has been removed from a host cell, subjected to laboratory manipulation, and introduced or reintroduced into a host cell is considered "non-native." Synthetic or partially synthetic genes introduced into a host cell are "non-native." Non-native genes further include genes endogenous to the host microorganism operably linked to one or more heterologous regulatory sequences that have been recombined into the host genome, or genes endogenous to the host organism that are in a locus of the genome other than that where they naturally occur.

The terms "naturally-occurring" and "wild-type" refer to a form found in nature. For example, a naturally occurring or wild-type nucleic acid molecule, nucleotide sequence or protein may be present in and isolated from a natural source, and is not intentionally modified by human manipulation.

"Nucleic acid" and "polynucleotide" are used interchangeably herein, and refer to both RNA and DNA, including cDNA, genomic DNA, synthetic DNA, and DNA or RNA containing nucleic acid analogs. Nucleic acids can have any three-dimensional structure. A nucleic acid can be double-stranded or single-stranded (i.e., a sense strand or an antisense strand). Non-limiting examples of nucleic acids include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A nucleic acid may contain unconventional or modified nucleotides.

As used herein, "operably linked" is intended to mean a functional linkage between two or more sequences. For example, an operably linkage between a polynucleotide of interest and a regulatory sequence (e.g., a promoter) is functional link that allows for expression of the polynucleotide of interest. In this sense, the term"operably linked" refers to the positioning of a regulatory region and a coding sequence to be transcribed so that the regulatory region is effective for regulating transcription or translation of the coding sequence of interest. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site. Operably linked elements may be contiguous or non-contiguous. When used to refer to the joining of two protein coding regions, by "operably linked" is intended that the coding regions are in the same reading frame. When used to refer to the effect of an enhancer, "operably linked" indicated that the enhancer increases the expression of a particular polypeptide or polynucleotides of interest.

"Percentage of sequence identity," as used herein, is determined by comparing two optimally locally aligned sequences over a comparison window defined by the length of the local alignment between the two sequences. The amino acid sequence in the comparison window may comprise additions or deletions (e.g., gaps or overhangs) as compared to the reference sequence (which does not comprise additions or deletions) for optimal alignment of the two sequences. Local alignment between two sequences only includes segments of each sequence that are deemed to be sufficiently similar according to a criterion that depends on the algorithm used to perform the alignment (e.g. BLAST). Unless otherwise specified, the comparison window for a selected sequence provided herein, e.g., "SEQ ID NO:X" is the entire length of SEQ ID NO:X, and, e.g., the comparison window for "100 bp of SEQ ID NO:X" is the stated 100 bp. The percentage identity is calculated by determining the number of positions at which the identical nucleic acid base or amino acid residue occurs in both sequences to yield the number of matched positions, dividing the number of matched positions by the total number of positions in the window of comparison and multiplying the result by 100. Optimal alignment of sequences for comparison may be conducted by the local homology algorithm of Smith and Waterman (*Add. APL. Math.* 2:482, 1981), by the global homology alignment algorithm of Needleman and Wunsch (*J. Mol. Biol.* 48:443, 1970), by the search for similarity method of Pearson and Lipman (*Proc. Natl. Acad. Sci. USA* 85: 2444, 1988), by heuristic implementations of these algorithms (NCBI BLAST, WU-BLAST, BLAT, SIM, BLASTZ), or by inspection. Given that two sequences have been identified for comparison, GAP and BESTFIT are preferably employed to determine their optimal alignment. Typically, the default values of 5.00 for gap weight and 0.30 for gap weight length are used. The term "substantial sequence identity" between polynucleotide or polypeptide sequences refers to polynucleotide or polypeptide comprising a sequence that has at least 50% sequence identity, preferably at least 70%, preferably at least 80%, more preferably at least 85%, more preferably at least 90%, even more preferably at least 95%, and most preferably at least 96%, 97%, 98% or 99% sequence identity compared to a reference sequence using the programs. In addition, pairwise sequence homology or sequence similarity, as used refers to the percentage of residues that are similar between two sequences aligned. Families of amino acid residues having similar side chains have been well defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Query nucleic acid and amino acid sequences were searched against subject nucleic acid or amino acid sequences residing in public or proprietary databases. Such searches were done using the National Center for Biotechnology Information Basic Local Alignment Search Tool (NCBI BLAST v 2.18) program. The NCBI BLAST program is available on the internet from the National Center for Biotechnology Information (blast.ncbi.nlm.nih.gov/Blast.cgi). Typically the following parameters for NCBI BLAST were used: Filter options were set to "default", the Comparison Matrix was set to "BLOSUM62", the Gap Costs were set to "Existence: 11, Extension: 1", the Word Size was set to 3, the Expect (E threshold) was set to 1e-3, and the minimum length of the local alignment was set to 50% of the query sequence length. Sequence identity and similarity may also be determined using GenomeQuest™ software (Gene-IT, Worcester, Mass. USA).

"Polypeptide" and "protein" are used interchangeably herein and refer to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition. As used herein, the expression "substantially conserved amino acid sequences" refers to regions of amino acid homology between polypeptides of the same type of family from different sources. One skilled in the art could align the amino acid sequences of PUFA-PKS synthase enzymes from different sources to identify the segments therein which are the substantially conserved amino acid sequences defined herein. The skilled person could then determine whether the identified segments have the characteristics disclosed and claimed in the present invention. It is to be understood that the expression "substantially conserved amino acid sequences" includes the segments which do not adversely affect the activity of the PUFA-PKS synthase enzyme.

As used herein "progeny" means a descendant, offspring, or derivative of an organism. For example, daughter cells from a transgenic bacterium are progeny of the transgenic bacterium. Because certain modifications may occur in succeeding generations due to either mutations or environmental influences, such progeny, descendant, or derivatives may not, in fact, be identical to the parent cell, but are still included within the scope of the term as used herein.

The term "regulatory element", as used in the present invention, refers to a nucleotide sequence that influences transcription or translation initiation and rate, and stability and/or mobility of a transcription or translation product. Such regulatory elements need not be of naturally-occurring sequences. Regulatory sequences include but are not limited to promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory element also may include at least one control element, such as an enhancer sequence, an upstream element or an upstream activation region (UAR). As used herein, a "promoter" refers to a transcription control sequence that is capable of initiating transcription in a host cell and can drive or facilitate transcription of a nucleotide sequence or fragment thereof of the instant invention. Such promoters need not be of naturally-occurring sequences. In addition, it will be understood that such promoters need not be derived from the target host cell or host organism.

As used herein, "transgenic organism" refers to an organism which comprises a heterologous polynucleotide. When applied to organisms, the terms "transgenic" or "recombinant" or "engineered" or "genetically engineered," used interchangeably herein, refer to organisms that have been manipulated by introduction into the organism of an exogenous or recombinant nucleic acid sequence. Generally, the heterologous polynucleotide is stably integrated within the genome such that the polynucleotide is passed on to successive generations, although it can also be present on an episome, and may be present on a synthetic chromosome of the transgenic organism. The non-native polynucleotide may be integrated into the genome alone or as part of a recombinant expression cassette. In additional examples, a transgenic microorganism can include an introduced exogenous regulatory sequence operably linked to an endogenous gene of the transgenic microorganism. Non-limiting examples of such manipulations include gene knockouts, targeted mutations and gene replacement, promoter replacement, deletion, or insertion, as well as introduction of transgenes into the organism. Recombinant or genetically engineered organisms can also be organisms into which constructs for gene "knock down" have been introduced. Such constructs include, but are not limited to, RNAi, microRNA, shRNA, antisense, and ribozyme constructs. Also included are organisms whose genomes have been altered by the activity of meganucleases, zinc finger nucleases, TALENs, or CRISPR nucleases. As used herein, "recombinant microorganism" or "recombinant host cell" includes progeny or derivatives of the recombinant microorganisms of the invention. Because certain modifications may occur in succeeding generations from either mutation or environmental influences, such progeny or derivatives may not, in fact, be identical to the parent cell, but are still included within the scope of the term as used herein.

For nucleic acids and polypeptides, the term "variant" is used herein to denote a polypeptide, protein, or polynucleotide molecule with some differences, generated synthetically or naturally, in their base or amino acid sequences as compared to a reference polypeptide or polynucleotide, respectively, such that the variant has at least 70% sequence identity to the reference polypeptide or polynucleotide. In other embodiments the variant can have at least 80%, at least 85%, at least 90% or at least 95%, at least 97%, at least 98%, or at least 99% sequence identity to the reference polypeptide or polynucleotide. For example, these differences include substitutions, insertions, deletions or any desired combinations of such changes in a reference polypeptide or polypeptide. Polypeptide and protein variants can further consist of changes in charge and/or post-translational modifications (such as glycosylation, methylation. phosphorylation, etc.).

When the term "variant" is used in reference to a microorganism, it typically refers to a strain microbial strain having identifying characteristics of the species to which it belongs, while having at least one nucleotide sequence variation or identifiably different trait with respect to the parental strain, where the trait is genetically based (heritable). For example, for a *Thraustochytrium* strain, identifiable traits include its FAME profile, and its 18S ribosomal RNA sequence.

The term "vector" refers to a nucleic acid construct designed for transfer between different host cells. As used herein, "vector" refers to a replicon, such as a plasmid, phage, or cosmid, into which another DNA segment may be inserted so as to bring about the replication of the inserted segment. Generally, a vector is capable of replication in a host cell when associated with the proper control elements, and in some examples includes both a selectable marker gene and at least one origin of replication or autonomous replication sequence (ARS) or origin of replication (ORI). The term "vector" includes cloning vectors and expression vectors, as well as viral vectors and integrating vectors. An "expression vector" is a vector that includes certain regulatory elements, thereby capable of expressing DNA sequences and fragments in a host cell (in vivo) or in vitro.

All publications and patent applications mentioned in this specification are herein incorporated by reference to the same extent as if each individual publication or patent application was specifically and individually indicated to be incorporated by reference.

PUFA-PKS Functional Domains

PUFA-PKS synthase activities are associated with one or more functional domains in each synthase polypeptide, wherein the functional domains can be identified by their conserved structural or functional motifs based on their homology to known motifs and can also be identified based upon their specific biochemical activities. See, e.g., U.S. Pat. Nos. 7,208,590; 7,214,853; 7,368,552; 7,799,564; 7,803,620; 7,816,504 7,816,505; 8,003,772; US Pat. Appl. Nos. US20090093033A1; US20100266564A1; and PCT Appl. Nos. WO2005097982A2; WO2010108114A2, each of which is incorporated by reference herein. Examples of PUFA synthase domains include: the beta-ketoacyl-ACP synthase (KS) domain, the malonyl-CoA:ACP acyltransferase (MAT) domain, the acyl carrier protein (ACP) domains, the ketoreductase (KR) domain, the beta-hydroxyacyl-ACP dehydrase (DH), the chain length factor (CLF) domain, the acyltransferase (AT) domain, and the enoyl-ACP reductase (ER) domain.

A polypeptide or domain of a polypeptide having beta-ketoacyl-ACP synthase (KS) biological activity (function) has been previously shown to be capable of carrying out the initial step of the fatty acid elongation reaction cycle. The term "beta-ketoacyl-ACP synthase" has been used interchangeably with the terms "3-keto acyl-ACP synthase," "beta-keto acyl-ACP synthase," and "keto-acyl ACP synthase." In some PKS systems, it has been shown that the acyl group for elongation is linked to a cysteine residue at the active site of KS by a thioester bond, and the acyl-KS undergoes condensation with malonyl-ACP to form-ketoacyl-ACP, $CO_2$, and unbound ("free") KS. In such systems, KS has been shown to possess greater substrate specificity than other polypeptides of the reaction cycle. Polypeptides (or domains of polypeptides) can be readily identified as belonging to the KS family by homology to known KS sequences (see, e.g., Shulse and Allen, *Environ. Microbial.* 13(3) 684-695, 2011).

A polypeptide or a domain of a polypeptide having malonyl-CoA:ACP acyltransferase (MAT) activity has been previously shown to be capable of transferring the malonyl moiety from malonyl-CoA to ACP. The term "malonyl-CoA:ACP acyltransferase" has been used interchangeably with "malonyl acyltransferase." In addition to the active site motif (GxSxG), MATs have been shown to possess an extended motif (R and Q amino acids in key positions). Polypeptides (or domains of polypeptides) can be readily identified as belonging to the MAT family by their homology to known MAT sequences and by their extended motif structure.

A polypeptide or a domain of a polypeptide having acyl carrier protein (ACP) activity has been previously shown to be capable of functioning as a carrier for growing fatty acyl chains via a thioester linkage to a covalently bound co-factor. ACPs are typically about 80 to about 100 amino acids long and have been shown to be converted from inactive apo-forms to functional holo-forms by transfer of the phosphopantetheinyl moiety of CoA to a highly conserved serine residue of the ACP. It has also been shown that acyl groups are attached to ACPs by a thioester linkage at the free terminus of the phosphopantetheinyl moiety. The presence of variations of an active site motif (LGIDS*) has also been recognized as a signature of ACPs. The functionality of the active site serine (S*) has been demonstrated in a bacterial PUFA synthase (Jiang et al., *J. Am. Chem. Soc.* 130:6336-7, 2008). Polypeptides (or domains of polypeptides) can be readily identified as belonging to the ACP family by labeling with radioactive pantetheine and by sequence homology to known ACPs.

A polypeptide or a domain of a polypeptide having dehydrase or dehydratase (DH) activity has been previously shown to be capable of catalyzing a dehydration reaction. Reference to DH activity typically refers to FabA-like beta-hydroxyacyl-ACP dehydrase biological activity. FabA-like beta-hydroxyacyl-ACP dehydrase biological activity removes HOH from a beta-ketoacyl-ACP and initially produces a trans-double bond in the carbon chain. The term "FabA-like beta-hydroxyacyl-ACP dehydrase" has been used interchangeably with the terms "FabA-like beta-hydroxy acyl-ACP dehydrase," "beta-hydroxyacyl-ACP dehydrase," and "dehydrase." The DH domains of PUFA synthase systems have previously been demonstrated as showing homology to bacterial DH enzymes associated with FAS systems (rather than to the DH domains of other PKS systems). See, e.g., U.S. Pat. No. 7,217,856. A subset of bacterial DHs, the FabA-like DHs, possesses cis-trans isomerase activity (Heath et al., *J. Biol. Chem.*, 271, 27795, 1996). Based on homology to the FabA-like DH proteins, one or all of the PUFA synthase system DH domains can be responsible for insertion of cis double bonds in the PUFA synthase products. A polypeptide or domain can also have non-FabA-like DH activity, or non-FabA-like beta-hydroxyacyl-ACP dehydrase (DH) activity. More specifically, a conserved active site motif of about 13 amino acids in length has been previously identified in PUFA synthase DH domains: LxxHxxxGxxxxP (the L position can also be an I in the motif). See, e.g., U.S. Pat. No. 7,217,856, and Donadio and Katz, *Gene* 111(1):51-60, 1992. This conserved motif is found in a similar region of known PUFA synthase sequences and could be responsible for a non-FabA like dehydration.

A polypeptide or a domain of a polypeptide having beta-ketoacyl-ACP reductase (KR) activity has been previously shown to be capable of catalyzing the pyridine-nucleotide-dependent reduction of 3-ketoacyl forms of ACP. The term "beta-ketoacyl-ACP reductase" has been used interchangeably with the terms "ketoreductase," "3-ketoacyl-ACP reductase," and "keto-acyl ACP reductase." It has been determined in many systems that KR function involves the first reductive step in the de novo fatty acid biosynthesis elongation cycle. Polypeptides (or domains of polypeptides) can be readily identified as belonging to the KR family by sequence homology to known PUFA synthase KRs.

A polypeptide or a domain of a polypeptide having chain length factor (CLF) activity has been previously defined as having one or more of the following activities or characteristics: (1) it can determine the number of elongation cycles and hence chain length of the end product, (2) it has homology to KS, but lacks the KS active site cysteine, (3) it can heterodimerize with KS, (4) it can provide the initial acyl group to be elongated, or (5) it can decarboxylate malonate (as malonyl-ACP), thus forming an acetate group that can be transferred to the KS active site and that can act as the 'priming' molecule that undergoes the initial elongation (condensation) reaction. A CLF domain is found in all currently identified PUFA synthase systems and in each case is found as part of a multi-domain protein. Polypeptides (or domains of polypeptides) can be readily identified as belonging to the CLF family by sequence homology to known PUFA synthase CLFs.

A polypeptide or a domain of a polypeptide having acyltransferase (AT) activity has been previously defined as having one or more of the following activities or characteristics: (1) it can transfer the fatty acyl group from the ACP domain(s) to water (i.e., a thioesterase), releasing the fatty acyl group as a free fatty acid, (2) it can transfer a fatty acyl group to an acceptor such as CoA, (3) it can transfer the acyl group among the various ACP domains, or (4) it can transfer the fatty acyl group to a lipophilic acceptor molecule (e.g. to lysophosphadic acid). Polypeptides (or domains of polypeptides) can be readily identified as belonging to the AT family by sequence homology to known PUFA synthase ATs.

A polypeptide or a domain of a polypeptide having enoyl-ACP reductase (ER) biological activity has been previously shown to be capable of reducing the trans-double bond (introduced by the DH activity) in the fatty acyl-ACP, resulting in saturation of the associated carbons. The ER domain in PUPA synthase systems has previously been shown to have homology to a family of ER enzymes (Heath et al., *Nature* 406: 145-146, 2000), and an ER homolog has been shown to function as an enoyl-ACP reductase in vitro (Bumpus et al. *J. Am. Chem. Soc.*, 130: 11614-11616, 2008). The term "enoyl-ACP reductase" has been used interchangeably with "enoyl reductase," "enoyl ACP-reductase," and "enoyl acyl-ACP reductase." Polypeptides (or domains of polypeptides) can be readily identified as belonging to the ER family by sequence homology to known PUFA synthase ERs.

Also provided are nucleic acid molecules encoding accessory proteins having phosphopantetheinyl transferase (PPTase) activity. Accessory proteins are defined herein as proteins that are generally not considered to be part of the core PUFA synthase system (i.e., not part of the PUFA synthase enzyme complex itself) but which may be necessary for PUFA production or efficient PUFA production using the core PUPA synthase enzyme complex of the present invention. For example, in order to produce PUFAs, a PUFA synthase system must work with an accessory protein that transfers a 4'-phosphopantetheinyl moiety from coenzyme A to the acyl carrier protein (ACP) domain(s). Therefore, a PUFA synthase system can be considered to include at least one 4'-phosphopantetheinyl transferase (PPTase) domain, or such a domain can be considered to be an accessory domain or protein to the PUFA synthase system. Structural and functional characteristics of PPTases have been described in detail, e.g., in U.S. Pat. Appl. Nos. US20020194641; US20040235127; and US20050100995. PPTase is homologous to the *Anabeana* HeTI as well as EntD from *E. coli* and Sfp of *Bacillus*. Recently, a new enzyme family of phosphopantetheinyl transferases has been identified that includes HetI, EntD and Sfp (Lamblot R H, et al., *Chemistry & Biology*, Vol 3, #11, 923-936, 1996). PPTase is required for addition of beta-alanine (i.e. pantetheine) to the ACP-containing protein (see, e.g. US Pat. Appl. No. US20030101486A1).

Figure 1:
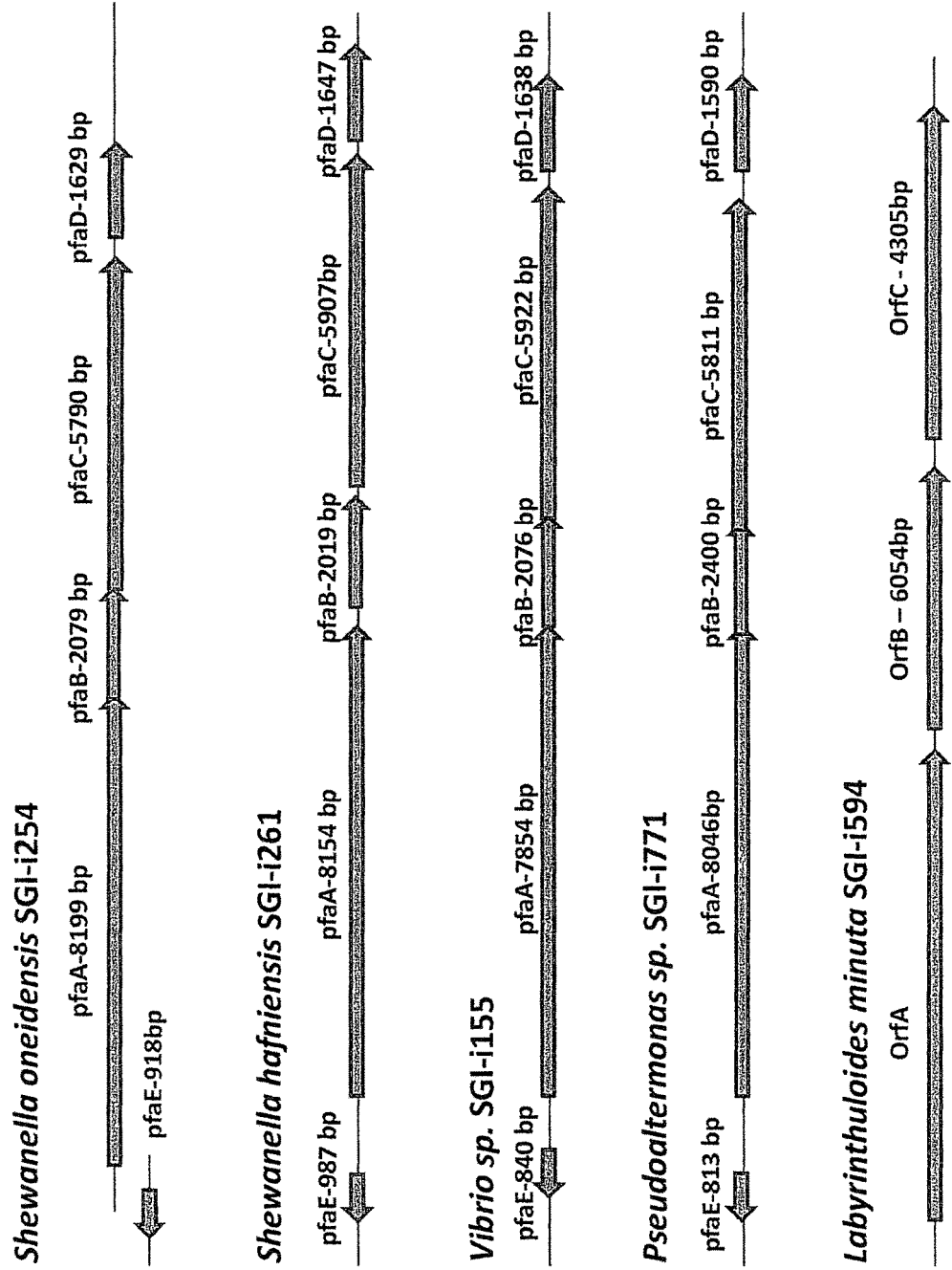
FIG. 1 depicts graphical gene organization of the PUFA biosynthetic clusters of the invention from the following microbial isolates: *Shewanella oneidensis* SGI-i254, *Shewanella hafniensis* SGI-i261, *Vibrio* sp. SGI-i155, *Pseudoaltermonas* sp. SGI-i771, *Labyrinthuloides minuta* SGI-i594, bacterial isolate SGI-i1605, bacterial isolate SGI-i1607, *Vibrio* sp. SGI-i1609, *Vibrio* sp. SGI-i1610, *Vibrio gigantis* SGI-i1611, *Aliivibrio* sp. SGI-i1612, *Psychromonas arctica* SGI-i1613, *Shewanella* sp. SGI-i1614, and *Shewanella* sp. SGI-i1615. Dotted lines in the gene structure of *Aliivibrio* sp. SGI-i1612 and *Shewanella* sp. SGI-i1614 denote gaps identified in the sequence contigs corresponding to the pfaA genes.
Figure 1:
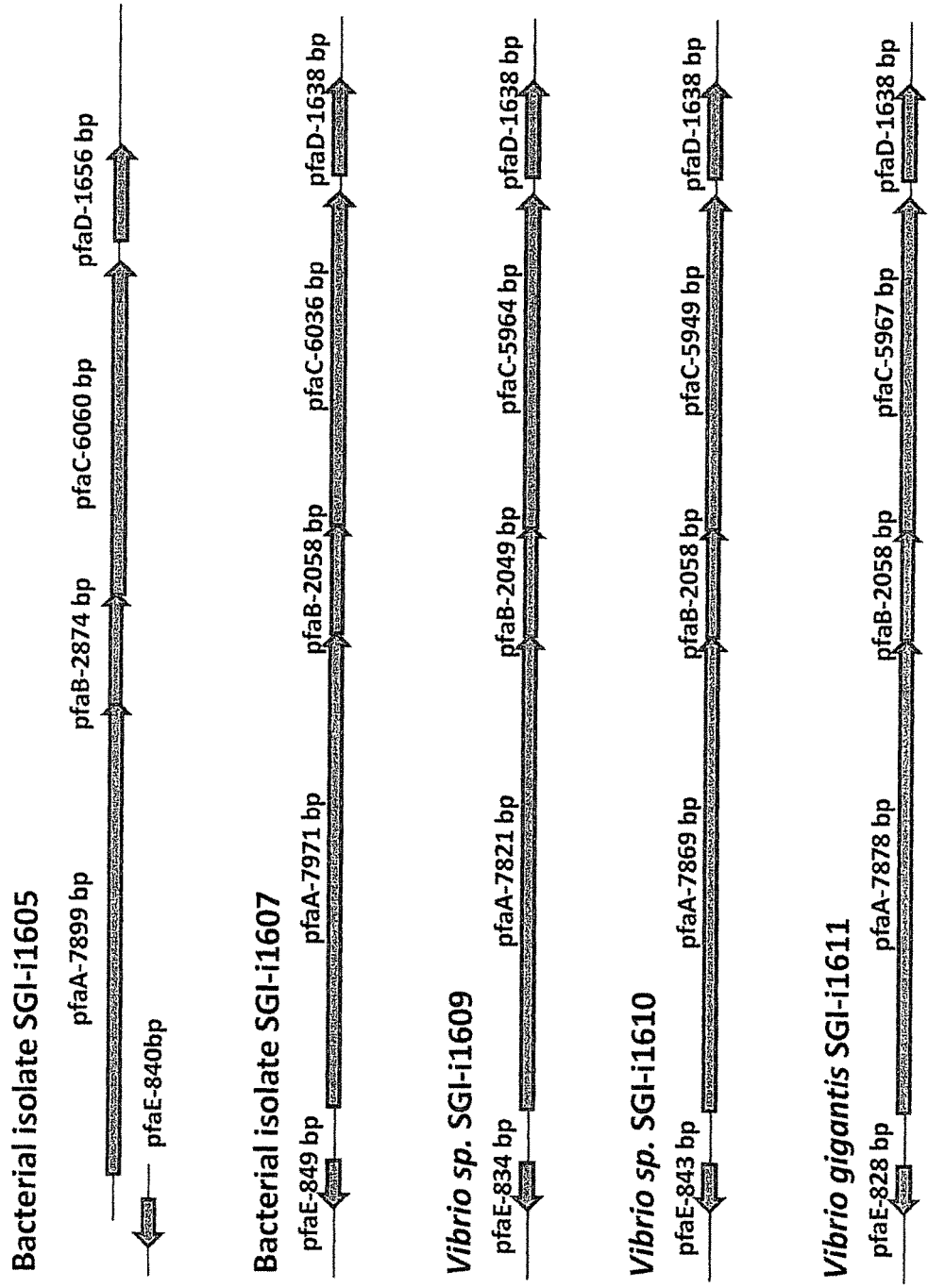
Figure 1:
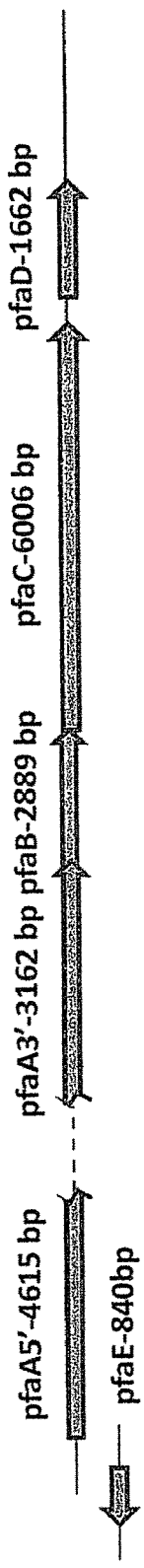
Figure 1:
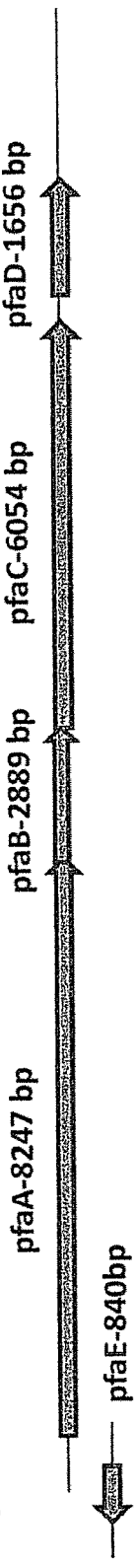
Figure 1:
Figure 1:
Figure 2:
FIG. 2 provides graphical representations of the domain architecture of the PUFA biosynthetic gene clusters from the following microbial isolates: *Shewanella oneidensis* SGI-i254, *Shewanella hafniensis* SGI-i261, *Vibrio* sp. SGI-i155, *Pseudoaltermonas* sp. SGI-i771, *Labyrinthuloides minuta*
Figure 2:
Figure 2:
Figure 2:
Figure 2:
Figure 2:
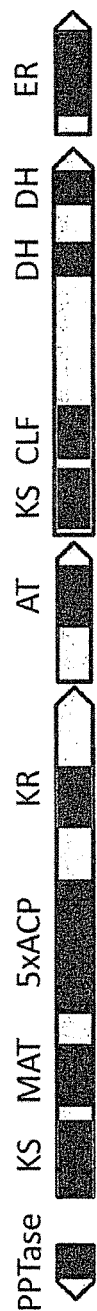
Figure 2:
Figure 2:
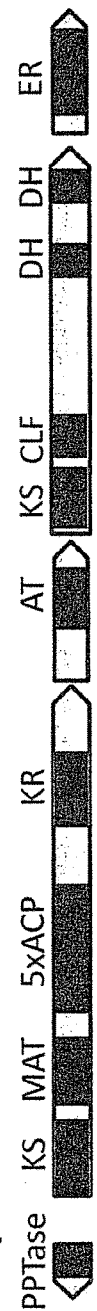
Figure 2:
Figure 2:
Figure 2:
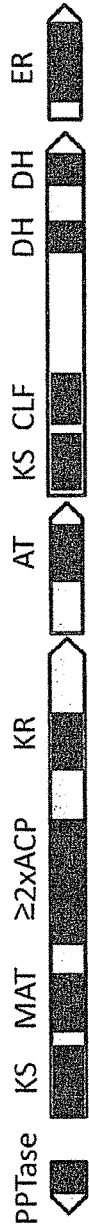
Figure 2:
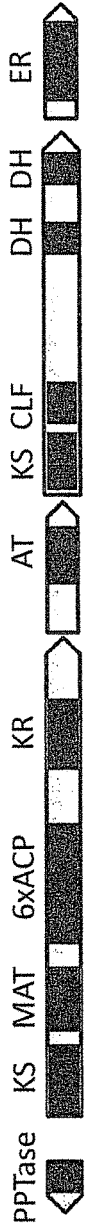
Figure 2:
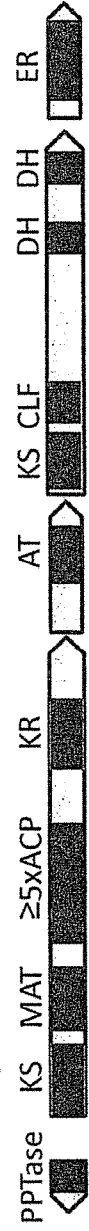
Figure 2:

Although prokaryotic gene architectures vary (see Shulse & Allen (2011) *PLoS One* Vol. 6 (5):e20146, incorporated by reference herein), EPA producing prokaryotes such as but not limited to *Shewanella, Vibrio, Photobacterium*, and *Pseudoaltermonas* have a common gene architecture referred to as a Type A PKS gene cluster, in which the pfaA gene typically includes the KS, MAT, and KR domains in addition to multiple ACP domains; the pfaB gene typically includes the AT domain, the pfaC gene typically includes the KS, CLF, and DH domains; the pfaD gene includes the ER domain, and the pfaE gene includes the PPTase domain. FIG. 2 provides gene architecture for PUFA-PKS systems provided herein from isolated prokaryotes *Shewanella* sp. SGI-i254, *Shewanella* sp. SGI-i261, *Pseudoalteromonas* sp. SGI-i771, *Vibrio* sp. SGI-i155, *Labyrinthuloides minuta* SGI-i594, bacterial isolate SGI-i1605, bacterial isolate SGI-i1607, *Vibrio* sp. SGI-i1609, *Vibrio* sp. SGI-i1610, *Vibrio gigantis* SGI-i1611, *Aliivibrio* sp. SGI-i1612, *Psychromonas arctica* SGI-i1613, *Shewanella* sp. SGI-i1614, and *Shewanella* sp. SGI-i1615.

Polynucleotides and Polypeptides of the Invention

In one aspect of the present invention, the disclosure provides novel isolated or recombinant nucleic acid molecules, nucleic acid molecules that hybridize to these nucleic acid molecules, nucleic acid molecules that encode novel polypeptides. Additional embodiments of the present application further include the polypeptides encoded by the novel isolated or recombinant nucleic acid molecules disclosed herein.

The polynucleotides and polypeptides of the present invention will preferably be "biologically active" with respect to either a structural attribute, such as the capacity of a nucleic acid to hybridize to another nucleic acid molecule, or the ability of a polypeptide to be bound by an antibody (or to compete with another molecule for such binding). Alternatively, such an attribute may be catalytic and thus involve the capacity of the molecule to mediate a chemical reaction or response. In some preferred embodiments of this aspect, the isolated nucleic acid molecules comprise a polynucleotide sequence encoding a polypeptide comprising PUFA synthase activity selected from the group consisting of acyl carrier protein (ACP) activity, acyl transferase (AT) activity, chain-length factor (CLF) activity, beta-hydroxyacyl-ACP dehydrase (DH) activity, enoyl reductase (ER) activity, ketoreductase (KR) activity, beta-keto acyl-ACP synthase (KS) activity, malonyl-CoA:ACP acyltransferase (MAT) activity, phosphopantetheinyl transferase (PPTase) activity, and any combinations thereof.

The polynucleotides and polypeptides of the present invention may also be recombinant. As used herein, the term "recombinant" or "engineered" as used herein in reference to a nucleic acid molecule or polypeptide, refer to a nucleic acid or polypeptide that has been altered through human manipulation. As non-limiting examples, a cDNA is a recombinant DNA molecule, as is any nucleic acid molecule that has been generated by in vitro polymerase reaction(s), or to which linkers have been attached, or that has been integrated into a vector, such as a cloning vector or expression vector. As non-limiting examples, a recombinant nucleic acid molecule: 1) has been synthesized or modified in vitro, for example, using chemical or enzymatic techniques (for example, by use of chemical nucleic acid synthesis, or by use of enzymes for the replication, polymerization, exonucleolytic digestion, endonucleolytic digestion, ligation, reverse transcription, transcription, base modification (including, e.g., methylation), or recombination (including homologous and site-specific recombination) of nucleic acid molecules; 2) includes conjoined nucleotide sequences that are not conjoined in nature; 3) has been engineered using molecular cloning techniques such that it lacks one or more nucleotides with respect to the naturally occurring nucleic acid molecule sequence; and/or 4) has been manipulated using molecular cloning techniques such that it has one or more sequence changes or rearrangements with respect to the naturally occurring nucleic acid sequence. Similarly, the term "recombinant protein" as used herein refers to a protein produced by genetic engineering, for example, by expression of a genetically engineered nucleic acid molecule in a cell.

Preferably, an isolated nucleic acid molecule of the present invention is produced using recombinant DNA technology (e.g., polymerase chain reaction (PCR) amplification, cloning, etc.) or chemical synthesis. Isolated nucleic acid molecules include natural nucleic acid molecules and homologs thereof, including, but not limited to, natural allelic variants and modified nucleic acid molecules in which nucleotides have been inserted, deleted, and/or substituted, in such a manner that such modifications provide the desired effect on PUFA-PKS synthase biological activity as described herein. Protein homologs (e.g., proteins encoded by nucleic acid homologs) are discussed in further detail elsewhere herein.

A nucleic acid molecule homolog can be produced using a number of methods known to those skilled in the art (see, for example, Sambrook et al., 1989, supra). For example, nucleic acid molecules can be modified using a variety of techniques including, but not limited to, classic mutagenesis techniques and recombinant DNA techniques, such as site-directed mutagenesis, chemical treatment of a nucleic acid molecule to induce mutations, restriction enzyme cleavage of a nucleic acid fragment, ligation of nucleic acid fragments, PCR amplification and/or mutagenesis of selected regions of a nucleic acid sequence, synthesis of oligonucleotide mixtures and ligation of mixture groups to "build" a mixture of nucleic acid molecules and combinations thereof. Nucleic acid molecule homologs can be selected from a mixture of modified nucleic acids by screening for the function of the protein encoded by the nucleic acid and/or by hybridization with a wild-type gene.

Nucleic acid molecules or fragment thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., In: *Molecular Cloning, A Laboratory Manual*, 2nd Edition, Cold Spring Harbor Press, Cold Spring Harbor, N.Y. (1989), and by Haynes et al. In: *Nucleic Acid Hybridization, A Practical Approach*, IRL Press, Washington, D.C. (1985). Departures from complete complementarity are therefore permissible, as long as such departures do not completely preclude the capacity of the molecules to form a double-stranded structure. Thus, in order for a nucleic acid molecule or fragment thereof of the present invention to serve as a primer or probe it needs only be sufficiently complementary in sequence to be able to form a stable double-stranded structure under the particular solvent and salt concentrations employed.

Appropriate stringency conditions which promote DNA hybridization include, for example, 6.0× sodium chloride/sodium citrate (SSC) at about 45° C., followed by a wash of 2.0×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed. These conditions are known to those skilled in the art, or can be found in *Current Protocols in Molecular Biology*, John Wiley & Sons, N.Y. (1989), 6.3.1-6.3.6. For example, low stringency conditions may be used to select nucleic acid sequences with lower sequence identities to a target nucleic acid sequence. One may wish to employ conditions such as about 0.15 M to about 0.9 M sodium chloride, at temperatures ranging from about 20° C. to about 55° C. High stringency conditions may be used to select for nucleic acid sequences with higher degrees of identity to the disclosed nucleic acid sequences (Sambrook et al., 1989, supra). High stringency conditions typically involve nucleic acid hybridization in about 2× to about 10×SSC (diluted from a 20×SSC stock solution containing 3 M sodium chloride and 0.3 M sodium citrate, pH 7.0 in distilled water), about 2.5× to about 5×Denhardt's solution (diluted from a 50× stock solution containing 1% (w/v) bovine serum albumin, 1% (w/v) ficoll, and 1% (w/v) polyvinylpyrrolidone in distilled water), about 10 mg/mL to about 100 mg/mL fish sperm DNA, and about 0.02% (w/v) to about 0.1% (w/v) SDS, with an incubation at about 50° C. to about 70×C for several hours to overnight. High stringency conditions are preferably provided by 6×SSC, 5×Denhardt's solution, 100 mg/mL fish sperm DNA, and 0.1% (w/v) SDS, with incubation at 55×C for several hours. Hybridization is generally followed by several wash steps. The wash compositions generally comprise 0.5× to about 10×SSC, and 0.01% (w/v) to about 0.5% (w/v) SDS with a 15-min incubation at about 20° C. to about 70° C. Preferably, the nucleic acid segments remain hybridized after washing at least one time in 0.1×SSC at 65° C.

According to some embodiments of the present application, nucleic acid molecules of the present invention will include those nucleic acid molecules that specifically hybridize to one or more of the nucleic acid molecules set forth in the Sequence Listing or complements thereof under low, moderate, or high stringency conditions. In a particularly preferred embodiment, nucleic acid molecules of the present invention preferably comprise a nucleic acid sequence that hybridizes high stringency conditions, to a nucleic acid sequence selected from the group consisting of SEQ ID NO:1, SEQ ID NO:3, SEQ ID NO:5, SEQ ID NO:7, SEQ ID NO:9, SEQ ID NO:11, SEQ ID NO:12, SEQ ID NO:13, SEQ ID NO:14, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, and SEQ ID NO:149; and complements of said nucleic acid sequences; and fragments of either.

A subset of the nucleic acid molecules of this invention includes fragments of the disclosed polynucleotides consisting of oligonucleotides of at least 12, at least 15, preferably at least 16 or 17, more preferably at least 18 or 19, and even more preferably at least 20 or more, consecutive nucleotides. Such oligonucleotides are fragments of the larger molecules having a sequence selected from the polynucleotide sequences in the Sequence Listing, and find use, for example, as interfering molecules, probes and primers for detection of the polynucleotides of the present invention. In a particularly preferred embodiment, nucleic acid molecules of the present invention preferably comprise fragments of a nucleic acid sequence selected from the group consisting of SEQ ID NO:1, SEQ ID NO:3, SEQ ID NO:5, SEQ ID NO:7, SEQ ID NO:9, SEQ ID NO:11, SEQ ID NO:12, SEQ ID NO:13, SEQ ID NO:14, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, and SEQ ID NO:149; and complements of said nucleic acid sequences; and fragments of either.

The minimum size of a nucleic acid molecule of the present invention is a size sufficient to form a probe or oligonucleotide primer that is capable of forming a stable hybrid (e.g., under moderate, high or very high stringency conditions) with the complementary sequence of a nucleic acid molecule disclosed herein, or of a size sufficient to encode an amino acid sequence having a biological activity of at least one domain of a PUFA-PKS synthase gene disclosed herein. As such, the size of the nucleic acid molecule encoding such a protein can be dependent on nucleic acid composition and percent homology or identity between the nucleic acid molecule and complementary sequence as well as upon hybridization conditions per se (e.g., temperature, salt concentration, and formamide concentration). The minimal size of a nucleic acid molecule that can be used as an oligonucleotide primer or as a probe is typically at least about 12 to about 15 nucleotides in length if the nucleic acid molecules are GC-rich and at least about 15 to about 18 bases in length if they are AT-rich. There is no limit, other than a practical limit, on the maximal size of a nucleic acid molecule of the present invention, in that the nucleic acid molecule can include a sequence sufficient to encode a biologically active fragment of a domain of a PUFA-PKS synthase, an entire PUFA-PKS synthase, or several domains within an open reading frame encoding a PUFA-PKS synthase.

In another embodiment, the present invention provides nucleotide sequences comprising regions that encode polypeptides. The encoded polypeptides may be the complete protein encoded by the gene represented by the polynucleotide, or may be fragments of the encoded protein. Preferably, polynucleotides provided herein encode polypeptides constituting a substantial portion of the complete protein, and more preferentially, constituting a sufficient portion of the complete protein to provide the relevant biological activity, e.g., a PUFA-PKS synthase activity.

Of particular interest are polynucleotides of the present invention that encode a PUFA-PKS synthase. Such polynucleotides may be expressed in transgenic cells or transgenic organisms to produce cells and organisms having modulated production of at least one PUFA. In a particularly preferred embodiment, nucleic acid molecules of the present invention preferably encode a polypeptide exhibiting at least 50%, at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:2, SEQ ID NO:4, SEQ ID NO:6, SEQ ID NO:8, SEQ ID NO:10, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, and SEQ ID NO:150; and fragments of said amino acid sequences. Such polynucleotides may be expressed in transgenic cells or transgenic organisms to produce cells and organisms having modulated production of at least one PUFA.

In some embodiments, nucleic acid molecules that are fragments of these PUFA-PKS encoding nucleotide sequences are also encompassed by the present invention. A "PUFA-PKS fragment", as used herein, is intended to be a portion of the nucleotide sequence encoding at least one domain indicative of a PUFA-PKS synthase activity. A fragment of a nucleotide sequence may encode a biologically active portion of a PUFA-PKS, or it may be a fragment that can be used as a hybridization probe or PCR primer using methods disclosed below. Nucleic acid molecules that are fragments of a PUFA-PKS encoding nucleotide sequence comprise at least about 50, 100, 200, 300, 400, 500, 600, 700, 800, 900, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, 2200, 2250, 2300, 2350, 2400, 2450, 2500, 2550, 2600, 2650, 2700, 2750, 2800, 2850, 2900, 2950, 3000, 3050, 3100, 3150, 3200, 3250, 3300, 3350 contiguous nucleotides, or up to the number of nucleotides present in a full-length PUFA-PKS encoding nucleotide sequence disclosed herein depending upon the intended use. The term "contiguous nucleotides" is intended to mean nucleotide residues that are immediately adjacent to one another. Fragments of the nucleotide sequences of the present invention include those that encode protein fragments that retain the biological activity of a PUFA-PKS synthase activity. By "retains activity" is intended that the fragment will have at least about 30%, at least about 50%, at least about 70%, 80%, 90%, 95% or higher of the PUFA-PKS synthase activity. Methods for measuring PUFA-PKS synthase activity are well known in the art.

A fragment of a PUFA-PKS-encoding nucleotide sequence that encodes a biologically active portion of a protein of the invention will encode at least about 15, 25, 30, 50, 75, 100, 125, 150, 175, 200, 250, 300, 350, 400, 450, 500, 550, 600, 650, 700, 750, 800, 850, 900, 950, 1000, 1050, 1100 contiguous amino acids, or up to the total number of amino acids present in a full-length PUFA-PKS protein of the invention. In some preferred embodiments, a polypeptide fragment of the invention comprises a PUFA synthase activity selected from the group consisting of acyl carrier protein (ACP) activity, acyl transferase (AT) activity, chain-length factor (CLF) activity, beta-hydroxyacyl-ACP dehydrase (DH) activity, enoyl reductase (ER) activity, ketoreductase (KR) activity, beta-keto acyl-ACP synthase (KS) activity, malonyl-CoA:ACP acyltransferase (MAT) activity, phosphopantetheinyl transferase (PPTase) activity, and any combinations thereof. For example, a polypeptide fragment of the invention may have an N-terminal or a C-terminal truncation of at least about 100 amino acids, about 120, about 130, about 140, about 150, or about 160 amino acids relative to any PUFA-PKS amino acid sequences set forth in the Sequence Listing.

An isolated, synthetic, or recombinant nucleic acid molecule as provided herein can have a nucleotide sequence that differs from the nucleotide sequence of a native gene, for example, the sequence can be optimized for expression in a eukaryotic host. Further, an isolated, synthetic, or recombinant nucleic acid molecule as provided herein can have be operably linked to a heterologous promoter, for example, a promoter for expression in a eukaryotic host.

Also of interest in the present invention are variants of the polynucleotides provided herein. Such variants may be naturally-occurring, including homologous polynucleotides from the same or a different species, or may be non-natural variants, for example polynucleotides synthesized using chemical synthesis methods, or generated using recombinant DNA techniques. With respect to nucleotide sequences, degeneracy of the genetic code provides the possibility to substitute at least one base of the protein encoding sequence of a gene with a different base without causing the amino acid sequence of the polypeptide produced from the gene to be changed. Hence, the DNA of the present invention may also have any base sequence that has been changed from any polynucleotide sequence in the Sequence Listing by substitution in accordance with degeneracy of the genetic code. References describing codon usage are readily publicly available. In further embodiments, polynucleotide sequence variants can be produced for a variety of reasons, e.g., to optimize codon expression for a particular host (e.g., changing codons in the bacterial mRNA to those preferred by other organisms such as *E. coli, Saccharomyces cerevisiae, Schizochytrium,* or *Thraustochytrium*).

The skilled artisan in the art will further appreciate that changes can be introduced by mutation of the nucleotide sequences of the invention, thereby leading to changes in the amino acid sequence of the encoded PUFA-PKS proteins, without altering the biological activity of the proteins. Thus, variant isolated nucleic acid molecules can be created by introducing one or more nucleotide substitutions, additions, or deletions into the corresponding nucleotide sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleotide sequences are also encompassed by the present invention.

For example, conservative amino acid substitutions may be made at one or more predicted nonessential amino acid residues. A "nonessential" amino acid residue, as used herein, is a residue that can be altered from the wild-type sequence of a PUFA-PKS protein without altering the biological activity, whereas an "essential" amino acid residue is required for biological activity. A "conservative amino acid substitution" is one in which the amino acid residue is replaced with an amino acid residue having a similar side chain. Families of amino acid residues having similar side chains have been well defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Alternatively, variant nucleotide sequences can be made by introducing mutations randomly along all or part of the coding sequence, such as by saturation mutagenesis, and the resultant mutants can subsequently be screened for ability to confer PUFA-PKS synthase activity in order to identify variants that retain PUFA-PKS synthase activity. For example, following mutagenesis, the encoded protein can be expressed recombinantly, and the activity of the protein can be determined using standard assay techniques. Methods for assaying PUFA-PKS synthase activity are well known in the art. In addition, using sequence-based methods such as PCR, hybridization, and the like, corresponding PUFA-PKS synthase sequences can be identified, such sequences having substantial identity to the sequences of the invention. See, for example, Sambrook and Russell (2001, supra.)

Nucleic acid molecules and fragments thereof of the present invention may also be employed to obtain nucleic acid homologs. Such homologs include the nucleic acid molecules of different alleles within a bacterial species or other organisms, including the nucleic acid molecules that encode, in whole or in part, protein homologs of other organisms, sequences of genetic elements such as promoters and transcriptional regulatory elements. Such molecules can be readily obtained by using the above-described nucleic acid molecules or fragments thereof to screen cDNA or genomic libraries obtained from such bacterial species or other organisms. Methods for forming such libraries are well known in the art. Such homolog molecules may differ in their nucleotide sequences from those found in one or more of the nucleotides in the Sequence Listing or complements thereof because complete complementarity is not needed for stable hybridization. The nucleic acid molecules of the present invention therefore also include molecules that, although capable of specifically hybridizing with the nucleic acid molecules may lack "complete complementarity." In a particular embodiment, methods of 3' or 5' RACE may be used to obtain such sequences.

Any of a variety of methods known in the art may be used to obtain one or more of the above-described nucleic acid molecules. Automated nucleic acid synthesizers can be employed for this purpose. In lieu of such synthesis, the disclosed nucleic acid molecules can be used to define a pair of primers that can be used with the polymerase chain reaction to amplify and obtain any desired nucleic acid molecule or fragment, which is standard in the art.

This invention also provides polypeptides that are encoded by the polynucleotides of the invention. Polypeptides provided in some preferred embodiments of this aspect are PUFA-PKS synthases. In some particularly preferred embodiments, the PUFA-PKS synthases of the invention are from bacterial species or from chytrid species of the order Thraustochytriales.

It is known in the art that one or more amino acids in a sequence can be substituted with other amino acid(s), the charge and polarity of which are similar to that of the substituted amino acid, i.e. a conservative amino acid substitution, resulting in a biologically/functionally silent change. Conservative substitutes for an amino acid within the polypeptide sequence can be selected from other members of the class to which the amino acid belongs. Amino acids can be divided into the following four groups: (1) acidic (negatively charged) amino acids, such as aspartic acid and glutamic acid; (2) basic (positively charged) amino acids, such as arginine, histidine, and lysine; (3) neutral polar amino acids, such as serine, threonine, tyrosine, asparagine, and glutamine; and (4) neutral nonpolar (hydrophobic) amino acids such as glycine, alanine, leucine, isoleucine, valine, proline, phenylalanine, tryptophan, cysteine, and methionine.

Conservative amino acid changes within the native polypeptides' sequence can be made by substituting one amino acid within one of these groups with another amino acid within the same group. Biologically functional equivalents of the polypeptides or fragments thereof of the present invention can have about 10 or fewer conservative amino acid changes, more preferably about 7 or fewer conservative amino acid changes, and most preferably about 5 or fewer conservative amino acid changes. In a preferred embodiment of the present invention, the polypeptide has between about 5 and about 500 conservative changes, more preferably between about 10 and about 300 conservative changes, even more preferably between about 25 and about 150 conservative changes, and most preferably between about 5 and about 25 conservative changes or between 1 and about 5 conservative changes. The encoding nucleotide sequence will thus have corresponding base substitutions, permitting it to encode biologically functional equivalent forms of the proteins or fragments of the present invention.

Altered or improved variants: It is contemplated that DNA sequences of a PUFA-PKS polypeptide may be altered by various methods, and that these alterations may result in DNA sequences encoding proteins with amino acid sequences different than that encoded by a PUFA-PKS synthase gene disclosed herein. This protein may be altered in various ways including amino acid substitutions, deletions, truncations, and insertions of one or more amino acids of the polypeptide sequences disclosed herein, including up to about 2, about 3, about 4, about 5, about 6, about 7, about 8, about 9, about 10, about 15, about 20, about 25, about 30, about 35, about 40, about 45, about 50, about 55, about 60, about 65, about 70, about 75, about 80, about 85, about 90, about 100, about 105, about 110, about 115, about 120, about 125, about 130 or more amino acid substitutions, deletions or insertions.

Methods for such manipulations are generally known in the art. For example, amino acid sequence variants of a PUFA-PKS synthase protein can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired PUFA-PKS synthase activity. However, it is understood that the ability of a PUFA-PKS synthase to produce a given PUFA may be improved by the use of such techniques upon the compositions of this invention.

Variant nucleotide and amino acid sequences of the present invention also encompass sequences derived from mutagenic and recombinogenic procedures such as DNA shuffling. With such a procedure, one or more different PUFA-PKS synthase protein coding regions can be used to create a new PUFA-PKS synthase protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a PUFA-PKS synthase gene of the invention and other known genes to obtain a new gene coding for a protein with an improved property of interest, such as an increased production of at least one PUFA. Strategies for such DNA shuffling are known in the art.

Alternatively or in addition, domain swapping or shuffling is another mechanism for generating altered PUFA-PKS synthase proteins. Conversed domains may be swapped between AHAS proteins, resulting in hybrid or chimeric PUFA-PKS synthase with improved overall PUFA productivity or modified fatty acid profiles. Methods for generating recombinant proteins and testing them for herbicide-tolerance activity are well known in the art.

The skilled artisan will further appreciate that any of a variety of methods well known in the art may be used to obtain one or more of the above-described polypeptides. The polypeptides of the invention can be chemically synthesized or alternatively, polypeptides can be made using standard recombinant techniques in heterologous expression systems such as E. coli, yeast, insects, etc.

One embodiment of the present invention relates to a recombinant nucleic acid molecule comprising a nucleic acid sequence encoding an amino acid sequence having a biological activity of at least one domain of a PUFA-PKS synthase as described herein. In general, the biological activity or biological action of a protein or domain refers to any function(s) exhibited or performed by the protein or domain that is ascribed to the naturally-occurring form of the protein as measured or observed in vivo (i.e., in the natural physiological environment of the protein) or in vitro (i.e., under laboratory conditions). As used herein, a functional domain of a PUFA-PKS synthase is a domain that is capable of performing a biological function of a PUFA-PKS synthase. For example, a biological activity of a PUFA-PKS and the individual domains that make up a PUFA-PKS synthase include acyl carrier protein (ACP) activity, acyl transferase (AT) activity, chain-length factor (CLF) activity, beta-hydroxyacyl-ACP dehydrase (DH) activity, enoyl reductase (ER) activity, ketoreductase (KR) activity, beta-keto acyl-ACP synthase (KS) activity, malonyl-CoA:ACP acyltransferase (MAT) activity, phosphopantetheinyl transferase (PPTase) activity, and any combinations thereof.

Nucleic Acid Constructs

Another aspect of the present invention relates to recombinant nucleic acid constructs comprising a nucleic acid sequence encoding a polypeptide of a PUFA-PKS as disclosed herein operably linked to a heterologous nucleic acid sequence. Typically, a recombinant nucleic acid construct of the present invention includes at least one nucleic acid sequence encoding an amino acid sequence having a biological activity of at least one functional domain of a PUFA-PKS synthase polypeptide as described herein, operably linked to one or more heterologous nucleic acid such as, for example, a regulatory element. In some embodiments, the regulatory element can be a transcription control sequence, which is included in a manner such that the nucleic acid molecule is able to be expressed when transfected (i.e., transformed, transduced, transfected, conjugated or conduced) into a host cell. Transcription control sequences most suitable for the purpose of the present invention include any transcription control sequence that can function in a host cell or organism into which the recombinant nucleic acid molecule is to be introduced.

In various examples a promoter operably linked to a nucleic acid encoding a polypeptide of a PUFA-PKS as disclosed herein can be a promoter derived from a labyrinthulomycetes species, e.g., a promoter having at least 80%, at least 85%, at least 90%, at least 95%, at least 96%, at least 97%, at least 98%, or at least 99% identity to the sequence of a naturally-occurring promoter of a species belonging to the labyrinthulomycetes. Such native promoters can be identified as sequences upstream of the initiating methionine of the coding region of a gene that regulate transcription of a gene. Methods for testing sequences for promoter activity are well known in the art. Nonlimiting examples of labyrinthulomycetes promoters isolated from an *Aurantiochytrium* strain and a *Schizochytrium* strain are provided in TABLE 1.

TABLE 1

Promoters from labyrinthulomycetes strains

| Gene Name | Promoter Fragment Length | SEQ ID NO |
|---|---|---|
| Neighbor of BRCA1 gene 1 (NBR1), transcript variant 1; allele 1 | 1057 | SEQ ID NO: 175 |
| Neighbor of BRCA1 gene 1 (NBR1), transcript variant 1; allele 6 | 1000 | SEQ ID NO: 176 |
| Eft2p GTPase| translation elongation factor 2 (EF-2); allele 3 | 927 | SEQ ID NO: 177 |
| Eft2p GTPase| translation elongation factor 2 (EF-2); allele 8 | 924 | SEQ ID NO: 178 |
| 40S ribosomal protein S3a (S3-a); allele 2 | 655 | SEQ ID NO: 179 |
| 40S ribosomal protein S3a (S3-a); allele 5 | 655 | SEQ ID NO: 180 |
| Eukaryotic translation initiation factor 5A isoform IV (IF-5a); allele 1 | 1000 | SEQ ID NO: 181 |
| Eukaryotic translation initiation factor 5A isoform IV (IF-5a); allele 2 | 1004 | SEQ ID NO: 182 |
| 60S ribosomal protein L9; Conserved predicted protein (RPL9); allele 1 | 860 | SEQ ID NO: 183 |
| 60S ribosomal protein L9; Conserved predicted protein (RPL9); allele 6 | 864 | SEQ ID NO: 184 |
| Actin A complement of Actin-1/3 (ActA); allele 3 | 492 | SEQ ID NO: 185 |
| Actin A complement of Actin-1/3 (ActA); allele 6 | 492 | SEQ ID NO: 186 |
| Actin A complement of Actin-1/3 (ActA); allele 8 | 492 | SEQ ID NO: 187 |
| Heat shock protein 70 (hsp70) | 1000 | SEQ ID NO: 188 |
| Translation elongation factor 1-alpha (EF-1a); allele 4 | 1031 | SEQ ID NO: 189 |
| Translation elongation factor 1-alpha (EF-1a); allele 7 | 1026 | SEQ ID NO: 190 |
| 60S ribosomal protein L26 (RPL26); allele 5 | 1000 | SEQ ID NO: 191 |
| 60S ribosomal protein L26 (RPL26); allele 7 | 996 | SEQ ID NO: 192 |
| Tubulin alpha (Tubα); allele 1 | 1002 | SEQ ID NO: 193 |
| Tubulin alpha (Tubα); allele 6 | 997 | SEQ ID NO: 16 |
| Transcriptionally-controlled tumor protein homolog (TCTP) | 1000 | SEQ ID NO: 194 |
| Acetyl-coenzyme A synthetase 2 (ACS2) | 1163 | SEQ ID NO: 195 |
| Tubulin alpha (Tubα) | 872 | SEQ ID NO: 151 |
| Heat shock protein 70 (hsp70) | 1004 | SEQ ID NO: 196 |
| Transcription elongation factor 3 (EF-3) | 1000 | SEQ ID NO: 197 |
| Hexose transporter 1 (HXT1) | 1000 | SEQ ID NO: 198 |
| Catalase (cat) | 1018 | SEQ ID NO: 199 |
| 60S ribosomal protein L9 (RPL9) | 994 | SEQ ID NO: 200 |
| 40s ribosomal protein S3a (RPS3a) | 1000 | SEQ ID NO: 201 |
| Tubulin beta chain (Tubβ) | 1000 | SEQ ID NO: 202 |
| Superoxide dismutase (SOD) | 976 | SEQ ID NO: 203 |
| Phosphoglycerate kinase (PGK) | 1033 | SEQ ID NO: 204 |
| Actin (Act); allele 4 | 1784 | SEQ ID NO: 205 |
| Actin (Act); allele 5 | 1776 | SEQ ID NO: 206 |
| Actin (Act); allele 6 | 1776 | SEQ ID NO: 207 |
| Elongation factor 1-alpha 1 (EF1alpha) | 2048 | SEQ ID NO: 208 |
| 60S ribosomal protein L6 (RPL6) | 1792 | SEQ ID NO: 209 |
| Actin depolymerase (Adp); allele A | 1739 | SEQ ID NO: 210 |
| Actin depolymerase (Adp); allele B | 1729 | SEQ ID NO: 211 |
| Adenosylhomocysteinase (AHC) | 1885 | SEQ ID NO: 212 |
| Alternative oxidase (AOX); allele B | 2015 | SEQ ID NO: 213 |
| Alternative oxidase (AOX); allele C | 1961 | SEQ ID NO: 214 |
| Cytochrome C oxidase (cox); allele A | 1764 | SEQ ID NO: 215 |
| Cytochrome C oxidase (cox); allele C | 1764 | SEQ ID NO: 216 |
| Elongation factor 1-beta (EF1beta) | 1774 | SEQ ID NO: 217 |
| Fa ATP synthase (faas) | 1973 | SEQ ID NO: 218 |
| Heavy metal associated domain (HMA); allele A | 1971 | SEQ ID NO: 219 |
| Heavy metal associated domain (HMA); allele B | 1930 | SEQ ID NO: 220 |
| Mitochondrial chaperonin 60 (hsp60); allele A | 1888 | SEQ ID NO: 221 |
| Mitochondrial chaperonin 60 (hsp60); allele B | 1838 | SEQ ID NO: 222 |
| Phosphotidylinositol 3-kinase (PI3K); allele A | 1635 | SEQ ID NO: 223 |
| Phosphotidylinositol 3-kinase (PI3K); allele C | 1637 | SEQ ID NO: 224 |
| 60s ribososomal protein 11 (RPL11); allele B | 1840 | SEQ ID NO: 225 |
| 60s ribososomal protein 11 (RPL11); allele C | 1844 | SEQ ID NO: 226 |
| Small nuclear ribonucleoprotein (snRNP) | 1890 | SEQ ID NO: 227 |
| Transcriptionally-controlled tumor protein homolog (TCTP) | 1956 | SEQ ID NO: 228 |
| Tetraspanin (Tsp); allele A | 1700 | SEQ ID NO: 229 |
| Tetraspanin (Tsp); allele B | 1680 | SEQ ID NO: 230 |

TABLE 1-continued

Promoters from labyrinthulomycetes strains

| Gene Name | Promoter Fragment Length | SEQ ID NO |
|---|---|---|
| Tubulin alpha (Tubα-738) | 738 | SEQ ID NO: 231 |
| Tubulin alpha (Tubα-522) | 522 | SEQ ID NO: 232 |
| Actin (act-1176) | 1176 | SEQ ID NO: 233 |
| Actin (act-776) | 776 | SEQ ID NO: 234 |
| Actin (act-557) | 557 | SEQ ID NO: 235 |
| Fa ATP synthase short (faas-776) | 776 | SEQ ID NO: 236 |
| Heavy metal associated domain short (HMA-796) | 796 | SEQ ID NO: 237 |
| Mitochondrial chaperonin 60 short (hsp60-) | 788 | SEQ ID NO: 238 |
| Phosphotidylinsositol 3-kinase short (PI3K-752) | 752 | SEQ ID NO: 239 |
| 60s ribososomal protein 11 short (RPL11-699) | 699 | SEQ ID NO: 240 |
| Tetraspanin short (Tsp-749) | 749 | SEQ ID NO: 241 |
| Actin depolymerase-short (Adp-830) | 830 | SEQ ID NO: 242 |

Any of the promoters of TABLE 1 may be operably linked to a nucleic acid sequence encoding a PUFA-PKS polypeptide as disclosed herein, e.g., a pfaA, pfaB, pfaC, pfaD, or pfaE polypeptide derived from a prokaryote. Further, promoters that include nucleotide sequence having at least 80%, at least 85%, at least 90%, at least 95%, at least 96%, at least 97%, at least 98%, or at least 99% identity to at least 100, at least 200, at least 300, at least 400, at least 500, at least 600, or at least 700 nucleotides of any of SEQ ID NO:16, SEQ ID NO:151, or SEQ ID NO:175-230 can be operably linked to a nucleotide sequence encoding a pfaA, pfaB, pfaC, pfaD, or pfaE polypeptide as disclosed herein, such as a nucleotide sequence encoding a pfa gene having at least identity to, a pfaB gene having at least. Such constructs can be used to transform labyrinthulomycetes strains to be used for the production of one or more PUFAs.

The invention further provides nucleic acid constructs comprising a nucleic acid sequence as provided herein operably linked to one or more sequences that can regulate or mediate transcription, translation, or integration of nucleotide sequences into a host genome. For example, the invention provides expression constructs that comprise one or more "expression control elements" or sequences that regulate expression transcription of an operably linked gene, or translation of the transcribed RNA. For example, an expression control element can be a promoter that can be operably linked to a gene of interest or antisense sequence in an expression construct or "expression cassette".

Recombinant nucleic acid constructs of the present invention can also contain additional regulatory sequences, such as translation regulatory sequences, origins of replication, and other regulatory sequences that are compatible with the recombinant cell.

It will be appreciated by one skilled in the art that a number of recombinant DNA technologies can be used to improve control of expression of transformed nucleic acid molecules by manipulating, for example, the number of copies of the nucleic acid molecules within the host cell, the efficiency with which those nucleic acid molecules are transcribed, the efficiency with which the resultant transcripts are translated, and the efficiency of post-translational modifications. Additionally, the promoter sequence might be genetically engineered to improve the level of expression as compared to the native promoter. Recombinant techniques useful for controlling the expression of nucleic acid molecules include, but are not limited to, integration of the nucleic acid molecules into one or more host cell chromosomes, addition of vector stability sequences to plasmids, substitutions or modifications of transcription control signals (e.g., promoters, operators, enhancers), substitutions or modifications of translational control signals (e.g., ribosome binding sites), modification of nucleic acid molecules to correspond to the codon usage of a particular host cell or of a particular cellular organelle, and deletion of sequences that destabilize transcripts.

In some embodiments, the isolated or recombinant nucleic acid molecules of the invention can comprise a recombinant vector. As used herein, a recombinant vector is an engineered (i.e., artificially produced) nucleic acid molecule that is used as a tool for manipulating a nucleic acid sequence of choice and for introducing such a nucleic acid sequence into a host cell. The recombinant vector is therefore suitable for use in cloning, sequencing, and/or otherwise manipulating the nucleic acid sequence of choice, such as by expressing and/or delivering the nucleic acid sequence of choice into a host cell to form a recombinant cell. The vector can be either RNA or DNA, either prokaryotic or eukaryotic, and typically is a plasmid. The vector can be maintained as an extrachromosomal element (e.g., a plasmid or an episome) or it can be integrated into the chromosome of a recombinant organism (e.g., a microbe or a plant). The entire vector can remain in place within a host cell, or under certain conditions, the plasmid DNA can be deleted, leaving behind the nucleic acid molecule of the present invention. The integrated nucleic acid molecule can be under chromosomal promoter control, under native or plasmid promoter control, or under a combination of several promoter controls. Single or multiple copies of the nucleic acid molecule can be integrated into the chromosome. A recombinant vector of the present invention can contain one or more selectable genetic markers.

General discussion above with regard to recombinant nucleic acid molecules and transformation of host cells is intended to be applied to any recombinant nucleic acid molecule discussed herein, including those encoding any amino acid sequence having a biological activity of at least one domain from a PUFA-PKS synthase.

Information in the Sequence Listing

This specification contains nucleotide and polypeptide sequence information prepared using the program PatentIn Version 3.5. The sequence descriptions and the Sequence Listing attached hereto comply with the rules governing nucleotide and/or amino acid sequences disclosures in patent application as set forth in 37 C.F.R. § 1.182-1.185.

For the amino acid sequences of the invention, the Sequence Listing provides (in miscellaneous features sections) one or several known homologs of the respective sequences. The Sequence Listing further provides (in miscellaneous features sections) indication of important identified dominant(s), domains, and motifs identified by comparison to the publicly available Pfam databases. Some amino acid sequences of the invention contain "Pfam" domains and motifs which are indicative of particular functions and/or applications. In particular, some amino acid sequences of the invention contain conserved domains and motifs which are indicative of PUFA-PKS synthase activity. The conserved domains indicative of PUFA-PKS synthase activity that Applicants have identified in the polypeptides described herein include the acyl transferase domain (AT, Pfam Acyl_transf_1; Pfam ID: PF00698), the beta-ketoacyl synthase, C-terminal domain (Pfam ketoacyl-synt_C; Pfam ID: PF02801), the beta-ketoacyl synthase, N-terminal domain (Pfam ketoacyl-synt; Pfam ID: PF00109), the phosphopantetheine attachment site motif (Pfam PP-binding; Pfam ID: PF00550), the short chain dehydrogenase domain (Pfam ID: PF00106), the polyketide synthase dehydratase domain (Pfam PS-DH; Pfam ID: PF14765), the ketoreductase KR domain (Pfam KR; Pfam ID: PF08659), the FabA-like domain (Pfam ID: PF07977), the nitronate monooxygenase/enoyl reductase (Pfam ID: PF03060), and the 4'-phosphopantetheinyl transferase superfamily domain (Pfam ID: PF01648). Description of the specific Pfam domains in more detail can be found at various resources, such as "www.sanger.ac.uk" or "pfam.janelia.org". Thus, various practical applications of the amino acid sequences in the sequence listing are immediately apparent to those of skill in the art based on their similarity to known sequences.

Recombinant Host Cells and Organisms

In one aspect, the present invention is directed to a host cell that expresses any of the nucleic acid molecules and recombinant nucleic acid molecules described above as well as combinations thereof. Host cells can include microbial cells; animal cells; plant cells; and insect cells. Representative examples of appropriate hosts include bacterial cells; thermophilic or mesophilic bacteria; marine bacteria; thraustochytrids; fungal cells, such as yeast; plant cells; insect cells; and isolated animal cells. Host cells can be either nonrecombinant cells or cells that are already transfected or transformed with at least one other recombinant nucleic acid molecule.

Host cells can be genetically engineered (transduced or transformed or transfected) with the nucleic acid molecules disclosed herein that can be, as nonlimiting examples, a cloning vector, a transformation vector, a homologous recombination vector, or an expression vector. Methods for introducing a polypeptide or polynucleotide into organism are well known in the art including, but not limited to, stable transformation methods, transient transformation methods, virus-mediated methods, and breeding. A vector used to introduce nucleic acid sequences into a host organism can be, for example, in the form of a plasmid, a viral particle, a phage, etc. The vector containing a polynucleotide sequence as described herein, as well as, optionally, an appropriate promoter or control sequence, can be employed to transform a host to permit expression of the polypeptide encoded by the polynucleotide sequence. The genetic modification of host cells can also include the optimization of genes for preferred or optimal host codon usage. In various aspects and embodiments, the polynucleotides of the invention may be codon-optimized for expression of the protein in a particular host cell or in a particular cellular organelle. Such methodologies are well known in the art. For example, codon usage tables listing the usage of each codon in many cells are known in the art (see, e.g., Nakamura et al, *Nucl. Acids Res.* 28: 292, 2000) or are readily derivable.

In various embodiments, a genetically modified microorganism that includes a nucleic acid molecule as provided herein can produce an increased amount of at least one PUFA with respect to a microorganism that does not include a nucleic acid molecule as provided herein. For example, the recombinant microorganism transformed with a nucleic acid molecule as provided herein can produce an increased amount of at least one of EPA or DHA with respect to a host microorganism that does not include a nucleic acid molecule as provided herein. In some examples, a recombinant microorganism transformed with a nucleic acid molecule as provided herein that encodes at least one polypeptide of a PUFA-PKS system, such as a prokaryotic PUFA-PKS system, can produce an increased amount of at least one of EPA with respect to a host microorganism that does not include a nucleic acid molecule encoding at least one polypeptide of a PUFA-PKS system. The genetically modified microorganism can be, in some instances, a eukaryotic microorganism such as a labyrinthulomycetes species that includes one or more non-native nucleic acid molecules that encode an entire PUFA-PKS system, e.g., can include non-native genes encoding all of a pfaA polypeptide, a pfaB polypeptide, a pfaC polypeptide, a pfaD polypeptide, and a pfaE polypeptide of a prokaryotic PUFA-PKS system, such as a Type A PUFA-PKS system of a prokaryotic microorganism that produces EPA.

Suitable microbial host cells to be modified using the materials and methods according to the present invention include, but are not limited to, bacteria, protists, microalgae, phytoplankton, fungi, and protozoa. In some embodiments, microbial host cells are eukaryotic microorganisms, such as, but not limited to, fungi and stramenopiles.

Non-limiting examples of preferred microbial species include, for instance, any microorganism of the class labyrinthulomycetes. While the classification of the Thraustochytrids, and Labyrinthulids has evolved over the years, for the purposes of the present application, "labyrinthulomycetes" is a comprehensive term that includes microorganisms of the orders Thraustochytrid and Labyrinthulid, and includes (without limitation) the genera *Althornia, Aplanochytrium, Aurantiochytrium, Corallochytrium, Diplophryids, Diplophrys, Elina, Japonochytrium, Labyrinthula, Labryinthuloides, Oblongichytrium, Pyrrhosorus, Schizochytrium, Thraustochytrium,* and *Ulkenia*. In some examples a host microorganism from a genus including, but not limited to *Thraustochytrium, Labyrinthuloides, Japonochytrium,* and *Schizochytrium*. Alternatively, a host labyrinthulomycetes microorganism can be from a genus including, but not limited to *Aurantiochytrium, Oblongichytrium,* and *Ulkenia*. Examples of suitable microbial species within the genera include, but are not limited to: any *Schizochytrium* species, including *Schizochytrium aggregatum, Schizochytrium limacinum, Schizochytrium minutum*; any *Thraustochytrium* species (including former *Ulkenia* species such as *U. visurgensis, U. amoeboida, U. sarkariana, U. profunda, U. radiata, U. minuta* and *Ulkenia* sp. BP-5601), and including *Thraustochytrium striatum, Thraustochytrium aureum, Thraustochytrium roseum*; and any *Japonochytrium* species. Strains of Thraustochytriales particularly suitable for the presently disclosed invention include, but are not limited to: *Schizochytrium* sp. (S31) (ATCC 20888); *Schizochytrium* sp. (S8) (ATCC 20889); *Schizochytrium* sp. (LC-RM) (ATCC 18915); *Schizochytrium* sp. (SR21); *Schizochytrium aggregatum* (ATCC 28209); *Schizochytrium limacinum* (IFO 32693); *Thraustochytrium* sp. 23B ATCC 20891; *Thraustochytrium striatum* ATCC 24473; *Thraustochytrium aureum* ATCC 34304); *Thraustochytrium roseum*(ATCC 28210; and *Japonochytrium* sp. L1 ATCC 28207.

In some embodiments of the present invention, preferred microorganisms to genetically modify include, but are not limited to, oleaginous microorganisms such as *Blakeslea, Candida, Cryptococcus, Cunninghamella, Lipomyces, Mortierella, Mucor, Phycomyces, Pythium, Rhodosporidium, Rhodotorula, Trichosporon,* or *Yarrowia,* and the like. Other examples of suitable host microorganisms for genetic modification include, but are not limited to yeast, including species of *Hansuela, Pichia, Saccharomyces Candida, Kluyveromyces,* or oleaginous yeast such species of *Apiotrichum, Cryptococcus Rhodosporidium Rhodotorula, Lipomyces, Trichosporon, Yarrowia lipolytica.* Exemplary species include, without limitation, *Apiotrichum curvatum, Cryptococcus curvatus, Rhodosporidium toruloides, Rhodotorula graminis, Rhodotorula glutinis, Lipomyces starkeyi, Trichosporon fermentans, Yarrowia lipolytica.* Other fungi, for example, filamentous fungi such as *Aspergillus, Neurospora, Penicillium,* etc. can also be hosts.

A number of methods and techniques useful for genetic transformation of microorganisms are well known in the art, and can be deployed for the methods of the present invention. The term "transformation" is preferably used herein to refer to the introduction of nucleic acid molecules into microbial cells, such as microalgae, chytrids, bacteria and yeast. Therefore, transformation techniques include, but are not limited to, transfection, electroporation, microinjection, lipofection, biolistic methods (particle bombardment), adsorption, *Agrobacterium*-mediated transformation, infection and protoplast fusion. Such genetic transformation can result in stable insertion and/or expression of transgenes from either the nucleus or the plastid, and in some cases can result in transient expression of transgenes.

Microprojectile bombardment, also referred to as microparticle bombardment, gene gun transformation, or biolistic bombardment, has been used successfully for several algal and chytrid species including, for example, *Phaeodactylum* (Apt et al., *Mol. Gen. Genet.,* 252:572-579, 1996), diatoms species *Cyclotella* and *Navicula* (Dunahay et al., *J. Phycol.,* 31:1004-1012, 1995), diatom *Cylindrotheca* (Fischer et al., *J. Phycol.,* 35:113-120, 1999), diatom species *Chaetoceros* sp. (Miyagawa-Yamaguchi et al., *Phycol. Res.* 59: 113-119, 2011), *Chlorella* (El-Sheekh, *Biologia Plantarum,* Vol. 42, No. 2:209-216, 1999), *Volvox* species (Jakobiak et al., *Protist,* 155:381-93, 2004), and chytrids *Schizochytrium* and *Thraustochytrium* (European Patent Appl. No. EP2623588A1; U.S. Pat. No. 7,001,772).

A transformation vector comprising a polynucleotide molecule of the present invention will typically comprise a marker gene that confers a selectable or scorable phenotype on target host cells, e.g., microbial cells, algal cells or plant cells. A number of selectable markers have been successfully developed for efficient isolation of genetic transformants of microorganisms. Common selectable markers include antibiotic resistance, fluorescent markers, and biochemical markers. Several different antibiotic resistance genes have been used successfully for microorganism transformation selection, including bleomycin (see, for example, Apt et al., 1996, supra; Fischer et al., 1999, supra; Fuhrmann et al., *Plant J.,* 19, 353-61, 1999, Lumbreras et al., *Plant J.,* 14(4):441-447, 1998; Zaslayskaia et al., *J. Phycol.,* 36:379-386, 2000), spectinomycin (Cerutti et al., *Genetics,* 145: 97-110, 1997; Doetsch et al., *Curr. Genet.,* 39, 49-60, 2001; Fargo, *Mol. Cell. Biol.,* 19:6980-90, 1999), streptomycin (Berthold et al., *Protist,* 153:401-412, 2002), paromomycin (Jakobiak et al., *Protist,* supra.; Sizova et al., *Gene,* 277: 221-229, 2001), nourseothricin (Zaslayskaia et al., 2000, supra), G418 (Dunahay et al., 1995, supra; Poulsen and Kroger, *FEBS Lett.,* 272:3413-3423, 2005, Zaslayskaia et al., 2000, supra), hygromycin (Berthold et al., 2002, supra), chloramphenicol (Poulsen and Kroger, 2005, supra), and many others. Additional selectable markers for use in microorganisms can be markers that provide resistance to kanamycin and amikacin resistance (Bateman, *Mol. Gen. Genet.* 263:404-10, 2000), zeomycin and phleomycin resistance (Stevens, *Mol. Gen. Genet.* 251:23-30, 1996), and paromomycin and neomycin resistance (Sizova et al., 2001, supra). Other fluorescent or chromogenic markers that have been used include luciferase (Falciatore et al., *J. Mar. Biotechnol.,* 1: 239-251, 1999; Fuhrmann et al., *Plant Mol. Biol.,* 2004; Jarvis and Brown, *Curr. Genet.,* 19: 317-322, 1991), β-glucuronidase (Chen et al., 2001, supra; Cheney et al., 2001, supra; Chow and Tung, 1999, supra; El-Sheekh, 1999, supra; Falciatore et al., 1999, supra; Kubler et al., *J. Mar. Biotechnol.,* 1:165-169, 1994), β-galactosidase (Gan et al., *J. Appl. Phycol.,* 15:345-349, 2003; Jiang et al., *Plant Cell Rep.,* 21:1211-1216, 2003; Qin et al., *High Technol. Lett.,* 13:87-89, 2003), and green fluorescent protein (GFP) (Cheney et al., 2001, supra; Ender et al., *Plant Cell,* 2002, Franklin et al., *Plant J.,* 2002; 56, 148, 210).

One skilled in the art would readily appreciate that a variety of known promoter sequences can be usefully deployed for transformation systems of microorganism species in accordance with the present invention.

In various embodiments of the present invention, some host cells may be transformed with multiple genes encoding one or more PUFA-PKS synthases. For example, a single transformed cell may contain exogenous nucleic acids encoding enzymes that make up an entire PUFA-PKS synthesis pathway such as, e.g., the recombinant chytrid cell lines disclosed herein at Examples 4 and 5 of the present disclosure, in which each of the recombinant cell lines have been triple-transformed with three different plasmid constructs (Examples 4 and 5). It is contemplated that a recombinant microorganism as disclosed herein that includes at least one non-native prokaryotic PUFA-PKS gene can include any one or more of a pfaA gene, a pfaB gene, a pfaC gene, a pfaD gene, or a pfaE gene of a prokaryotic PUFA-PKS system. For example, a recombinant microorganism as disclosed herein that includes at least one non-native prokaryotic PUFA-PKS gene can include any one or more of a pfaA gene, a pfaB gene, a pfaC gene, a pfaD gene, or a pfaE gene of a prokaryotic PUFA-PKS system, such as but not limited to a Type A PUFA-PKS system of an EPA-producing prokaryote such as, for example, a species of *Shewanella, Vibrio, Psuedoaltermonas,* or *Photobacterium.*

A recombinant microorganism can include, for example, a pfaA gene that encodes a polypeptide having at least 65%, at least 70%, at least 75%, at least 80%, at least 85%, at least 90%, at least 95%, at least 96%, at least 97%, at least 98%, or at least 99% identity to an amino acid sequence of any prokaryotic PUFA-PKS pfaA polypeptide, such as, for example, any of SEQ ID NO:2, SEQ ID NO:18, SEQ ID NO:28, SEQ ID NO:38, SEQ ID NO:48, SEQ ID NO:58, SEQ ID NO:68, SEQ ID NO:78, SEQ ID NO:88, SEQ ID NO:98, SEQ ID NO:108, SEQ ID NO:110, SEQ ID NO:120, SEQ ID NO:130, SEQ ID NO:132, and SEQ ID NO:142. In some examples, a recombinant microorganism can include a nucleic acid sequence encoding a pfaA polypeptide having at least 65%, at least 70%, at least 75%, at least 80%, at least 85%, at least 90%, at least 95%, at least 96%, at least 97%, at least 98%, or at least 99% identity to SEQ ID NO:2, SEQ ID NO:18, or SEQ ID NO:38.

Alternatively or in addition, a recombinant microorganism can include a pfaB gene that encodes a polypeptide having at least 65%, at least 70%, at least 75%, at least 80%, at least 85%, at least 90%, at least 95%, at least 96%, at least 97%, at least 98%, or at least 99% identity to an amino acid sequence of any prokaryotic PUFA-PKS pfaB polypeptide, such as, for example, any of SEQ ID NO:4, SEQ ID NO:20, SEQ ID NO:30, SEQ ID NO:40, SEQ ID NO:50, SEQ ID NO:60, SEQ ID NO:70, SEQ ID NO:80, SEQ ID NO:90, SEQ ID NO:100, SEQ ID NO:112, SEQ ID NO:122, SEQ ID NO:134, and SEQ ID NO:144. In some examples, a recombinant microorganism can include a nucleic acid sequence encoding a pfaB polypeptide having at least 65%, at least 70%, at least 75%, at least 80%, at least 85%, at least 90%, at least 95%, at least 96%, at least 97%, at least 98%, or at least 99% identity to SEQ ID NO:4, SEQ ID NO:20, or SEQ ID NO:40.

Further alternatively or in addition, a recombinant microorganism can include a pfaC gene that encodes a polypeptide having at least 65%, at least 70%, at least 75%, at least 80%, at least 85%, at least 90%, at least 95%, at least 96%, at least 97%, at least 98%, or at least 99% identity to an amino acid sequence of any prokaryotic PUFA-PKS pfaC polypeptide, such as, for example, any of SEQ ID NO:6, SEQ ID NO:22, SEQ ID NO:32, SEQ ID NO:42, SEQ ID NO:54, SEQ ID NO:62, SEQ ID NO:72, SEQ ID NO:82, SEQ ID NO:92, SEQ ID NO:102, SEQ ID NO:114, SEQ ID NO:124, SEQ ID NO:136, and SEQ ID NO:146. In some examples, a recombinant microorganism can include a nucleic acid sequence encoding a pfaC polypeptide having at least 65%, at least 70%, at least 75%, at least 80%, at least 85%, at least 90%, at least 95%, at least 96%, at least 97%, at least 98%, or at least 99% identity to SEQ ID NO:6, SEQ ID NO:22, or SEQ ID NO:42.

Yet further alternatively or in addition, a recombinant microorganism can include a pfaD gene that encodes a polypeptide having at least 65%, at least 70%, at least 75%, at least 80%, at least 85%, at least 90%, at least 95%, at least 96%, at least 97%, at least 98%, or at least 99% identity to an amino acid sequence of any prokaryotic PUFA-PKS pfaD polypeptide, such as, for example, any of SEQ ID NO:8, SEQ ID NO:24, SEQ ID NO:34, SEQ ID NO:44, SEQ ID NO:54, SEQ ID NO:64, SEQ ID NO:74, SEQ ID NO:84, SEQ ID NO:94, SEQ ID NO:104, SEQ ID NO:116, SEQ ID NO:126, SEQ ID NO:138, and SEQ ID NO:148. In some examples, a recombinant microorganism can include a nucleic acid sequence encoding a pfaD polypeptide having at least 65%, at least 70%, at least 75%, at least 80%, at least 85%, at least 90%, at least 95%, at least 96%, at least 97%, at least 98%, or at least 99% identity to SEQ ID NO:8, SEQ ID NO:24, or SEQ ID NO:44.

Further alternatively or in addition, a recombinant microorganism can include a pfaE gene that encodes a polypeptide having at least 65%, at least 70%, at least 75%, at least 80%, at least 85%, at least 90%, at least 95%, at least 96%, at least 97%, at least 98%, or at least 99% identity to an amino acid sequence of any prokaryotic PUFA-PKS pfaE polypeptide, such as, for example, any of SEQ ID NO:10, SEQ ID NO:26, SEQ ID NO:36, SEQ ID NO:46, SEQ ID NO:56, SEQ ID NO:66, SEQ ID NO:76, SEQ ID NO:86, SEQ ID NO:96, SEQ ID NO:106, SEQ ID NO:118, SEQ ID NO:128, SEQ ID NO:140, and SEQ ID NO:150. In some examples, a recombinant microorganism can include a nucleic acid sequence encoding a pfaE polypeptide having at least 65%, at least 70%, at least 75%, at least 80%, at least 85%, at least 90%, at least 95%, at least 96%, at least 97%, at least 98%, or at least 99% identity to an amino acid sequence selected from the group consisting of SEQ ID NO:10, SEQ ID NO:26, or SEQ ID NO:46.

In various examples, a recombinant microorganism as provided herein can include at least one non-native gene encoding a pfaA gene of a PUFA-PKS system, at least one non-native gene encoding a pfaB gene of a PUFA-PKS system, at least one non-native gene encoding a pfaC gene of a PUFA-PKS system, at least one non-native gene encoding a pfaD gene of a PUFA-PKS system, and at least one non-native gene encoding a pfaE gene of a PUFA-PKS system.

Specifically contemplated are recombinant eukaryotic microorganisms that include at least one non-native pfaA gene, at least one non-native pfaB gene, at least one non-native pfaC gene, at least one non-native pfaD gene, and at least one non-native pfaE gene. The non-native pfaA, pfaB, pfaC, pfaD, and pfaE genes can encode polypeptide having sequences derived from (e.g., having at least 85%, at least 90%, at least 95%, at least 96%, at least 97%, at least 98%, or at least 99% sequence identity to) polypeptides of prokaryotic microorganisms, such as prokaryotic microorganisms that naturally produce EPA. For example the polypeptide sequences can be derived from polypeptides encoded by a prokaryotic Type A PUFA-PKS gene cluster. The non-native pfaA, pfaB, pfaC, pfaD, and pfaE genes can be, for example, genes disclosed hereinabove. The eukaryotic microorganism can be a labyrinthylomycetes, such as, for example, a species of *Aurantiochytrium*, *Schizochytrium*, *Thraustochytrium*, or *Ulkenia*, and in some examples, can produce more EPA than a control microorganism that does not include a non-native gene encoding a PUFA-PKS polypeptide.

Lipid Production

Lipids can be produced using one or more isolated labyrinthulomycete microorganisms of the invention or a derivative thereof. Various fermentation parameters for inoculating, growing, and recovering biomass from labyrinthulomycetes are known in the art, such as described in U.S. Pat. No. 5,130,242 and US Patent Application Publication US20080155705.

Any medium for growth of labyrinthulomycete microorganisms can be used. For example, recipes for cultivating labyrinthulomycetes can be found in U.S. Pat. No. 8,207,363, and are also provided in the Examples herein. The culture medium can optionally contain natural or artificial sea water that can be present at a dilution of, for example 1% to 99% of the final media formulation. A culture medium for labyrinthulomycete microorganisms includes at least one carbon source for the microorganism. Examples of carbon sources that can be present in the culture medium include, but are not limited to, glucose, fructose, galactose, L-fucose (derived from galactose), lactose, lactulose, maltose, maltriose xylose, saccharose, soluble starch, dextrin (derived from corn) and alpha-cyclodextrin (derived from starch), glycogen, gelatin, molasses, corn steep liquor, m-inositol (derived from corn steep liquor), glucosamine, dextran, fats, oils, glycerol, acetate (e.g., sodium acetate, potassium acetate), acetic acid, mannitol, ethanol, galacturonic acid (derived from pectin), cellobiose (derived from cellulose) and polyols such as maltitol, erythritol, adonitol and oleic acids such as glycerol and tween 80 and amino sugars such as N-acetyl-D-galactosamine, N-acetyl-D-glucosamine and N-acetyl-β-D-mannosamine. The culture medium can include a nitrogen source, which can be, for example, an inorganic nitrogen source, such as ammonium acetate, ammonium sulfate, ammonium chloride, or ammonium nitrate. Alternatively or in addition, a nitrogen source provided in the culture medium can be an organic nitrogen source, including, as nonlimiting examples, peptone, yeast extract, polypeptone, malt extract, soy flour, meat extract, fish meal, casamino acids, corn steep liquor, glutamate, or urea. The culture medium also includes a form of phosphate, such as potassium phosphate or sodium-phosphate, and inorganic-salts, acids, or bases such as, for example, ammonium sulfate, ammonium hydroxide, potassium hydroxide, sodium bicarbonate, boric acid, citric acid, phosphoric acid, sodium orthovanadate, potassium chromate, potassium chloride, sodium molybdate, selenous acid, nickel sulfate, copper sulfate, zinc sulfate, cobalt chloride, iron chloride, manganese chloride and calcium chloride that can supply nutrients, including trace nutrients. One or more chelating compounds (e.g., ethylenediaminetetraacetic acid, citric acid or citrate) can also be present in the culture medium. Additionally, one or more vitamins such as but not limited to pyridoxine hydrochloride, thiamine hydrochloride, calcium pantothenate, p-aminobenzoic acid, riboflavin, nicotinic acid, biotin, folic acid and vitamin $B_{12}$ may be present as a media component.

In some embodiments, the culture medium comprises at least 5%, at least 10%, at least 20%, at least 30%, at least 40%, at least 50%, at least 60%, at least 70%, at least 80%, or at least 90% dissolved oxygen, as a percentage of saturation level. In some embodiments, the culture medium comprises from about 5% to about 20%, about 5% to about 50%, about 5% to about 100%, about 10% to about 20%, about 10% to about 50%, about 10% to about 100%, about 20% to about 50%, or about 20% to about 100% dissolved oxygen, as a percentage of saturation level.

The fermentation volume can be any feasible volume. In some embodiments, the fermentation volume (volume of culture) is at least about 1 liter or at least about 2 liters, at least about 5 liters, at least about 10 liters, at least about 50 liters, at least about 100 liters, at least about 200 liters, at least about 500 liters, at least about 1000 liters, at least about 10,000 liters, at least about 20,000 liters, at least about 50,000 liters, at least about 100,000 liters, at least about 150,000 liters, at least about 200,000 liters, or at least about 250,000 liters. In some embodiments, the fermentation volume is about 1 liter to about 300,000 liters, about 2 liters, about 10 liters, about 50 liters, about 100 liters, about 200 liters, about 500 liters, about 1000 liters, about 10,000 liters, about 20,000 liters, about 50,000 liters, about 100,000 liters, about 150,000 liters, about 200,000 liters, about 250,000 liters, or about 300,000 liters.

Fermentation can be conducted at a temperature of from about 15° C. to about 40° C., for example from about 17° C. to about 35° C., or from about 18° C. to about 35° C., or from about 20° C. to about 32° C., or from about 22° C. to about 30° C. For example, at least one stage of fermentation can be performed at a temperature of about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., or about 35° C. The culture medium can have a pH of from about 4.0 to about 8.5, for example, the culture medium can have a pH of from about 4.2 to about 8.0, or from about pH 4.5 to about pH 7.8, or from about 5.0 to about 7.5, for example fermentation can be in a medium at from about pH 4.5 to about pH 5.0, from about pH 5.0 to about pH 5.5, from about pH 5.5 to about pH 6.0, from about pH 6.0 to about pH 6.5, from about pH 6.5 to about pH 7.0, from about pH 7.0 to about pH 7.5, from about pH 7.5 to about pH 8.0, or from about pH 8.0 to about pH 8.5.

Cultivation can be carried out for 1 to 30 days, 1 to 21 days, 1 to 15 days, 1 to 12 days, 1 to 9 days, or preferably 3 to 5 days at temperatures between 4 to 40° C., preferably 18 to 35° C., by aeration-shaking culture, shaking culture, stationary culture, batch culture, fed-batch culture, continuous culture, rolling batch culture, or wave culture, or the like. In various culture methods, there may be two or more culture phases (for example, a growth phase and a lipid production phase) that may differ in, for example, temperature, dissolved oxygen concentration, degree of stirring or agitation, availability of one or more nutrients, etc.

In some embodiments, culture of an isolated labyrinthulomycete as provided herein has an omega-3 fatty acid productivity of at least about 2 g/L/day, at least about 4 g/L/day, or at least about 8 g/L/day after growing for about 7 days at about 15° C. to about 35° C. in a culture medium of about pH 4.5 to about pH 8.0 comprising sources of carbon, nitrogen, and nutrients. In some embodiments, the isolated labyrinthulomycete culture has an omega-3 fatty acid productivity of between about 1 g/L/day to about 30 g/L/day, about 2 g/L/day to about 25 g/L/day, about 2 g/L/day to about 25 g/L/day, about 3 g/L/day to about 20 g/L/day, or about 4 g/L/day to about 20 g/L/day, after growing for about 7 days at about 20° C. to about 35° C. in a culture medium of about pH 4.5 to about pH 7.5 comprising sources of carbon, nitrogen, and other nutrients.

Extraction

A variety of procedures can be employed in the recovery of the resultant cellular biomass from fermentation in various culture media, such as by filtration or centrifugation. The cells can then be washed, frozen, lyophilized, or spray dried, and stored under a non-oxidizing atmosphere to eliminate the presence of oxygen, prior to incorporation into a processed food or feed product.

The lipid containing one or more PUFAs can be obtained by breaking or disrupting the collected cell biomass, for example, via milling, ultrasonication, or any other convenient means, and then carrying out extraction with a solvent such as chloroform, hexane, methylene chloride, methanol, ethanol or via supercritical fluid extraction means. The omega-3 polyunsaturated fatty acids may be further concentrated by hydrolyzing the lipids and concentrating the highly unsaturated fraction by employing traditional methods such as urea adduction or fractional distillation, column chromatography, or by supercritical fluid fractionation. The cells can also be broken or lysed and the lipids extracted into vegetable or animal (e.g. fish oils) oils. The extracted oils can be refined by well-known processes routinely employed to refine vegetable oils (e.g. by chemical or physical refining). These refining processes remove impurities from extracted oils before they are used or sold as edible oils. After refining, the oils can be used directly as a feed or food additive to produce omega-3 enriched products. Alternatively, the oil can be further processed and purified as outlined below and then used in the above applications and also in pharmaceutical applications.

In another process for the production of enriched (concentrated) omega-3 oils, the harvested cellular biomass (fresh or dried) can be ruptured or permeabilized by well-known techniques such as sonication, liquid-shear disruption methods, bead milling, pressing under high pressure, freeze-thawing, or enzymatic digestion of the cell wall. The lipids from the ruptured cells are extracted by use of a solvent or mixture of solvents such as hexane, chloroform, ether, or methanol. The solvent is removed and the lipids hydrolyzed by using any of the well-known methods for converting triglycerides to free fatty acids or esters of fatty acids including base, acid, or enzymatic hydrolysis. After hydrolysis is completed, the nonsaponifiable compounds are extracted into a solvent such as ether, hexane or chloroform and removed. The remaining solution is then acidified by addition of an acid, and the free fatty acid extracted into a solvent such as hexane, ether or chloroform. The solvent solution containing the free fatty acids can then be cooled to a temperature low enough for crystallization of the non-PUFA compounds, which can then be removed via filtration, centrifugation or settling. Resulting in the concentration of the remaining PUFA compounds and used as a nutritional supplements for humans, as a food additive, or as pharmaceutical applications.

The discussion of the general methods given herein is intended for illustrative purposes only. Other alternative methods and embodiments will be apparent to those of skill in the art upon review of this disclosure, and are to be included within the spirit and purview of this application.

It should also be understood that the following examples are offered to illustrate, but not limit, the invention.

EXAMPLES

The following examples are included merely for purposes of illustration of certain aspects and embodiments of the present invention, and are not intended to limit the invention in any way. Other alternative methods and embodiments will be apparent to those of skill in the art upon review of this disclosure.

Example 1

Identification of Novel PUFA-PKS Synthases in Several Microbial Isolates by High-throughput Sequencing and in Silico Sequence Analyses The following microbial isolates were obtained from the proprietary microorganism collection of Synthetic Genomics, Inc.: *Shewanella* sp. SGI-i254, *Shewanella* sp. SGI-i261, *Pseudoalteromonas* sp. SGI-i771, *Vibrio* sp. SGI-i155, *Labyrinthuloides minuta* SGI-i594, bacterial isolate SGI-i1605, bacterial isolate SGI-i1607, *Vibrio* sp. SGI-i1609, *Vibrio* sp. SGI-i1610, *Vibrio gigantic* SGI-i1611, *Aliivibrio* sp. SGI-i1612, *Psychromonas arctica* SGI-i1613, *Shewanella* sp. SGI-i1614, and *Shewanella* sp. SGI-i1615. Whole genomic DNA content of the bacterial isolates was first individually isolated by standard procedures. See, e.g., Sambrook and Russell, 2001. *Molecular cloning: A laboratory manual,* 3rd edition. Cold Spring Harbor Laboratory Press, Cold Spring Harbor, N.Y.

The gDNA samples were individually shot-gun sequenced, assembled and annotated by using procedures described in PCT Patent Publication No. WO2010115156A2. Coding gene sequences were predicted from assembled contigs using an approach that combined evidence from multiple sources using the Evigan consensus gene prediction method as described previously by Liu et al. *Bioinformatics*, March 1; 24(5):597-605. 2008. All candidate ORFs on a sequence contig were first predicted based on stop codons found on all six frames and allowing for run-on in order to include partial ORFs. Candidate ORF translations were then annotated using Blastp searches against the NCBI non-redundant protein database and FastHMM (at microbesonline.org/fasthmm/) searches against Pfam (Finn et al., *Nucleic Acids Res.* 2008) and Superfamily (see, e.g., Inskeep et al., *PLoS,* 2010) domain databases. De novo ORF predictions were also made using 3 prokaryotic gene finding tools: Glimmer (Delcher et al., Bioinformatics, March 15; 23(6):673-9, 2007), Prodigal (at compbio.ornl.gov/prodigal/), and Metagene (Brunet et al., *Proc Natl Acad Sci USA*, March 23; 101(12):4164-9, 2004). The evidence from the blast/FastHMM searches and de novo gene finders was then combined in an unsupervised manner using Evigan. Since the start sites predicted by Evigan do not necessarily correspond to start codons, the predicted ORFs were extended upstream to the closest start codon in the same coding frame. The consensus gene prediction was performed by first binning contigs based on GC content and then running Evigan on each 10,000 contig bin separately.

Contigs resulting from the assembly and annotation process as described above were then tested for presence of polynucleotide sequences encoding novel PUFA-PKS by comparing the sequences against a database consisting of known PUFA-PKS systems using the BLASTX algorithm (Altschul et al., *Nucl. Acids Res.* 25:3389-3402, 1997). The analysis of the assembled and annotated sequences identified several genes belonging to major classes of PfaA, PfaB, PfaC, PfaD, and PPTase (see, e.g. TABLE 2). For each of the isolates i155, i254, and i771, the genomic sequences obtained from shot-gun sequencing data and in silico re-assembled contigs contained a gap in the ACP region of the pfaA gene. In order to identify nucleotide sequences of the gaps, primers were designed to PCR amplify the region and the PCR fragments were sequenced by Sanger sequencing method. The sequence information was then added to the shot-gun sequencing data to close the gaps. Primers used for PCR amplification reactions are listed below:

```
Isolate i155
                                     (SEQ ID NO: 152)
155pfaA_fwd1: 5'-TACAGGTGGGCTTGACGCCG-3';

(SEQ ID NO: 153)
155 pfaA_rev1: 5'-GACCATCATCGGTGATCACAACAC-3'

Isolate i254
                                     (SEQ ID NO: 154)
254pfaA fwd1: 5'-AGGCGAGATTGTTGATTACATGC-3'

(SEQ ID NO: 155)
254pfaA rev1: 5'-TCTCGACGCGCTTGATTGAG-3'

Isolate i771
                                     (SEQ ID NO: 156)
771pfaA_fwd1: 5'-CAGCTGCACCTGTAACTACATCAG-3';

(SEQ ID NO: 157)
771pfaA_rev1: 5'-ACTGCTGGCGCAACTGCTAC-3'
```

Domain analysis was performed to annotate the sequence coordinates for the PUFA-PKS synthase domains. Conserved domains and motifs indicative of PUFA-PKS synthase activity were identified based on sequence homology to known PUFA-PKS synthases. The conserved domains indicative of PUFA-PKS synthase activity that Applicants have identified in the polypeptides described herein include the acyl transferase domain (AT, Pfam Acyl_transf_1; Pfam ID: PF00698), the beta-ketoacyl synthase, C-terminal domain (Pfam ketoacyl-synt_C; Pfam ID: PF02801), the beta-ketoacyl synthase, N-terminal domain (Pfam ketoacyl-synt; Pfam ID: PF00109), the phosphopantetheine attachment site motif (Pfam PP-binding; Pfam ID: PF00550), the short chain dehydrogenase domain (Pfam ID: PF00106), the polyketide synthase dehydratase domain (Pfam PS-DH; Pfam ID: PF14765), the ketoreductase KR domain (Pfam KR; Pfam ID: PF08659), the FabA-like domain (Pfam ID: PF07977), the nitronate monooxygenase/enoyl reductase (Pfam ID: PF03060), and the 4'-phosphopantetheinyl transferase superfamily domain (Pfam ID: PF01648). TABLE 2 provides examples of the PUFA-PKS polypeptides identified by the procedure described herein, along with the respective Pfam identifiers of the polypeptides as indicated in the Sequence Listing, and the conserved domains identified in each of the polypeptides, as well as positions of the amino acid residues representing the conserved domains. Further description of the specific Pfam domains identified herein can be found at various scientific web resources, such as "www.sanger.ac.uk" or "pfam.janelia.org". Thus, various practical applications of the amino acid sequences in the sequence listing are immediately apparent to those of skill in the art based on their similarity to known sequences.

TABLE 2

PUFA-PKS polypeptides, along with sequence identifiers of the polypeptides, the conserved domains identified in each of the polypeptides, and the Start and End positions of the amino acid residues representing the conserved domains.

| Source Organism | SEQ ID | Conserved domains | START-END of conserved domains |
|---|---|---|---|
| *Shewanella* sp. SGI-i254, pfaA | 2 | PF00698, PF02801, PF00109, PF00550, PF00550, PF00550, PF00550, PF00550, PF00550, PF00106, PF00106, PF08659, PF14765 | 601-928, 303-420, 18-295, 1208-1273, 1315-1381, 1426-1492, 1538-1603, 1649-1714, 1759-1824, 2110-2175, 2198-2323, 2110-2338, 2418-2693 |
| *Shewanella* sp. SGI-i254, pfaB | 4 | PF00698 | 472-617 |
| *Shewanella* sp. SGI-i254, pfaC | 6 | PF02801, PF07977, PF07977, PF00109, PF00109 | 293-415, 1328-1462, 1787-1920, 8-285, 488-704 |
| *Shewanella* sp. SGI-i254, pfaD | 8 | PF03060 | 88-363 |
| *Shewanella* sp. SGI-i254, pfaE | 10 | PF01648 | 140-203 |
| *Shewanella* sp. SGI-261, pfaA | 18 | PF00698, PF02801, PF00109, PF00550, PF00550, PF00550, PF00550, PF00550, PF00106, PF00106, PF08659 | 629-965, 316-433, 31-308, 1279-1345, 1384-1451, 1491-1557, 1593-1660, 1701-1765, 2084-2170, 2162-2290, 2084-2305 |
| *Shewanella* sp. SGI-261, pfaB | 20 | PF00698 | 293-601 |
| *Shewanella* sp. SGI-261, pfaC | 22 | PF02801, PF07977, PF07977, PF00109, PF00109 | 306-423, 1371-1510, 1826-1959, 17-298, 498-764 |
| *Shewanella* sp. SGI-261, pfaD | 24 | PF03060 | 95-370 |
| *Shewanella* sp. SGI-261, pfaE | 26 | PF01648 | 158-222 |
| *Pseudoalteromonas* sp. SGI-i771, pfaA | 28 | PF00698, PF02801, PF00109, PF00550, PF00550, PF00550, PF00550, PF00550, PF00550, PF00106, PF08659, PF14765 | 611-939, 321-439, 34-313, 1234-1300, 1339-1404, 1441-1506, 1540-1605, 1646-1711, 1744-1809, 2175-2297, 2093-2318, 2400-2667 |
| *Pseudoalteromonas* sp. SGI-i771, pfaB | 30 | PF00698, PF02801 | 602-776, 159-249 |
| *Pseudoalteromonas* sp. SGI-i771, pfaC | 32 | PF02801, PF02801, PF07977, PF07977, PF00109, PF00109 | 289-402, 767-849, 1328-1461, 1793-1927, 2-280, 473-743 |
| *Pseudoalteromonas* sp. SGI-i771, pfaD | 34 | PF03060 | 80-351 |
| *Pseudoalteromonas* sp. SGI-i771, pfaE | 36 | PF01648 | 124-187 |
| *Vibrio* sp. SGI-i155, pfaA | 38 | PF00698, PF02801, PF00109, PF00550, PF00550, PF00550, PF00550, PF00550, PF00106, PF00106, PF08659, PF14765 | 599-929, 309-426, 24-301, 1238-1305, 1337-1404, 1437-1503, 1543-1610, 1646-1712, 2041-2066, 2100-2218, 2014-2236, 2303-2578 |
| *Vibrio* sp. SGI-i155, pfaB | 40 | PF00698 | 313-611 |
| *Vibrio* sp. SGI-i155, pfaC | 42 | PF02801, PF07977, PF07977, PF00109, PF0010 | 294-412, 1355-1488, 1826-1957, 11-286, 489-755 |
| *Vibrio* sp. SGI-i155, pfaD | 44 | PF03060 | 93-366 |
| *Vibrio* sp. SGI-i155, pfaE | 46 | PF01648 | 121-184 |
| *Labyrinthuloides minuta* SGI-i594 | 48 | PF00698, PF02801, PF00109 | 581-891, 289-407, 3-281 |

TABLE 2-continued

PUFA-PKS polypeptides, along with sequence identifiers of the polypeptides, the
conserved domains identified in each of the polypeptides, and the Start and End
positions of the amino acid residues representing the conserved domains.

| Source Organism | SEQ ID | Conserved domains | START-END of conserved domains |
| --- | --- | --- | --- |
| *Labyrinthuloides minuta* SGI-i594 | 50 | PF02801, PF00109 | 289-357, 2-281 |
| *Labyrinthuloides minuta* SGI-i594 | 52 | PF00106, PF08659 | 299-421, 216-434 |
| *Labyrinthuloides minuta* SGI-i594 | 54 | PF00698, PF02801, PF02801, PF00109, PF00109, PF03060 | 1219-1363, 352-421, 812-882, 24-296, 488-758, 1543-1836 |
| *Labyrinthuloides minuta* SGI-i594 | 56 | PF07977, PF07977, PF03060 | 283-409, 758-891, 965-1254 |
| Bacterial isolate SGI-i1605, pfaA | 58 | PF00698, PF02801, PF00109, PF00550, PF00550, PF00550, PF00550, PF00550, PF00106, PF06920, PF08659 | 598-920, 309-427, 22-301, 1248-1313, 1356-1422, 1464-1529, 1575-1640, 1686-1751, 2123-2244, 1037-1138, 2040-2265, |
| Bacterial isolate SGI-i1605, pfaB | 60 | PF00698 | 460-941 |
| Bacterial isolate SGI-i1605, pfaC | 62 | PF02801, PF02801, PF07977, PF07977, PF00109, PF00109 | 293-408, 799-886, 1385-1518, 1877-2010, 2-285, 481-763 |
| Bacterial isolate SGI-i1605, pfaD | 64 | PF03060 | 96-376, |
| Bacterial isolate SGI-i1605, pfaE | 66 | PF01648, | 130-192, |
| Bacterial isolate SGI-i1607, pfaA | 68 | PF00698, PF02801, PF00109, PF00550, PF00550, PF00550, PF00550, PF00550, PF00106, PF08659 | 643-950, 353-470, 68-345, 1294-1360, 1395-1463, 1497-1564, 1599-1665, 1705-1770, 2150-2269, 2065-2286 |
| Bacterial isolate SGI-i1607, pfaB | 70 | PF00698 | 159-658 |
| Bacterial isolate SGI-i1607, pfaC | 72 | PF02801, PF07977, PF07977, PF00109, PF00109 | 306-424, 1389-1522, 1858-1990, 23-298, 499-768 |
| Bacterial isolate SGI-i1607, pfaD | 74 | PF03060 | 93-366, |
| Bacterial isolate SGI-i1607, pfaE | 76 | PF01648 | 124-187, |
| *Vibrio* sp. SGI-i1609, pfaA | 78 | PF00698, PF02801, PF00109, PF00550, PF00550, PF00550, PF00550, PF00550, PF00106, PF08659 | 599-906, 309-426, 24-301, 1247-1314, 1348-1416, 1451-1518, 1552-1619, 1655-1720, 2100-2219, 2015-2236 |
| *Vibrio* sp. SGI-i1609, pfaB | 80 | PF00698 | 155-655 |
| *Vibrio* sp. SGI-i1609, pfaC | 82 | PF02801, PF07977, PF07977, PF00109, PF00109 | 304-422, 1384-1517, 1846-1978, 21-296, 497-767 |
| *Vibrio* sp. SGI-i1609, pfaD | 84 | PF03060 | 93-366 |
| *Vibrio* sp. SGI-i1609, pfaE | 86 | PF01648 | 119-182 |
| *Vibrio* sp. SGI-i1610, pfaA | 88 | PF00698, PF02801, PF00109, PF00550, PF00550, PF00550, PF00550, PF00550, PF00106, PF08659 | 599-906, 309-426, 24-301, 1254-1320, 1360-1428, 1463-1530, 1565-1631, 1671-1736, 2116-2235, 2031-2252 |
| *Vibrio* sp. SGI-i1610, pfaB | 90 | PF00698 | 159-658 |
| *Vibrio* sp. SGI-i1610, pfaC | 92 | PF02801, PF07977, PF07977, PF00109, PF00109 | 308-426, 1377-1510, 1841-1973, 25-300, 501-771 |
| *Vibrio* sp. SGI-i1610, pfaD | 94 | PF03060 | 93-366 |
| *Vibrio* sp. SGI-I1610, pfaE | 96 | PF01648 | 124-187 |
| *Vibrio gigantis* SGI-i1611, pfaA | 98 | PF00698, PF02801, PF00109, PF00550, PF00550, PF00550, PF00550, PF00550, PF00106, PF08659 | 599-906, 309-426, 24-301, 1252-1318, 1358-1426, 1461-1528, 1568-1634, 1674-1739, 2119-2238, 2034-2255 |

TABLE 2-continued

PUFA-PKS polypeptides, along with sequence identifiers of the polypeptides, the conserved domains identified in each of the polypeptides, and the Start and End positions of the amino acid residues representing the conserved domains.

| Source Organism | SEQ ID | Conserved domains | START-END of conserved domains |
|---|---|---|---|
| *Vibrio gigantis* SGI-i1611, pfaB | 100 | PF00698 | 158-658 |
| *Vibrio gigantis* SGI-i1611, pfaC | 102 | PF02801, PF07977, PF07977, PF00109, PF00109 | 312-430, 1384-1517, 1841-1973, 29-304, 505-775 |
| *Vibrio gigantis* SGI-i1611, pfaD | 104 | PF03060, | 93-366 |
| *Vibrio gigantis* SGI-i1611, pfaE | 106 | PF01648 | 124-187 |
| *Aliivibrio* sp. SGI-i1612, pfaA | 108 | PF00698, PF02801, PF00109 | 598-922, 309-427, 22-301 |
| *Aliivibrio* sp. SGI-i1612, pfaA | 110 | PF00106, PF08659, PF00550, PF00550 | 544-667, 461-686, 6-48, 107-172 |
| *Aliivibrio* sp. SGI-i1612, pfaB | 112 | PF00698 | 761-929 |
| *Aliivibrio* sp. SGI-i1612, pfaC | 114 | PF02801, PF02801, PF07977, PF07977, PF00109, PF00109 | 293-407, 799-886, 1377-1510, 1859-1992, 2-285, 481-760 |
| *Aliivibrio* sp. SGI-i1612, pfaD | 116 | PF03060, | 98-373 |
| *Aliivibrio* sp. SGI-i1612, pfaE | 118 | PF01648, | 130-192 |
| *Psychromonas arctica* SGI-i1613, pfaA | 120 | PF00698, PF02801, PF00109, PF00550, PF00550, PF00550, PF00550, PF00550, PF00550, PF00106, PF08659 | 604-921, 315-433, 28-307, 1272-1337, 1382-1447, 1475-1540, 1592-1657, 1706-1770, 1812-1877, 2245-2367, 2161-2387 |
| *Psychromonas arctica* SGI-i1613, pfaB | 122 | PF00698, | 480-944 |
| *Psychromonas arctica* SGI-i1613, pfaC | 124 | PF02801, PF02801, PF07977, PF07977, PF00109, PF00109 | 296-411, 812-896, 1389-1522, 1875-2008, 2-288, 484-770 |
| *Psychromonas arctica* SGI-i1613, pfaD | 126 | PF03060 | 96-371 |
| *Psychromonas arctica* SGI-i1613, pfaE | 128 | PF01648 | 120-182 |
| *Shewanella* sp. SGI-i1614, pfaA | 130 | PF00698, PF02801, PF00109, PF00550, PF00550, PF00550 | 602-927, 303-420, 18-295, 1228-1295, 1334-1400, 1440-1505 |
| *Shewanella* sp. SGI-i1614, pfaA | 132 | PF00106, PF00106, PF08659, PF00550, PF00550 | 470-541, 557-683, 470-698, 8-73, 110-175 |
| *Shewanella* sp. SGI-i1614, pfaB | 134 | PF00698, | 353-656 |
| *Shewanella* sp. SGI-i1614, pfaC | 136 | PF02801, PF07977, PF07977, PF00109, PF00109 | 305-427, 1375-1509, 1827-1960, 8-297, 507-775 |
| *Shewanella* sp. SGI-i1614, pfaD | 138 | PF03060 | 88-363 |
| *Shewanella* sp. SGI-i1614, pfaE | 140 | PF01648 | 145-207 |
| *Shewanella* sp. SGI-i1615, pfaA | 142 | PF00698, PF02801, PF00109, PF00550, PF00550, PF00550, PF00550, PF00550, PF00106, PF00106, PF08659 | 602-927, 303-420, 18-295, 1228-1295, 1334-1400, 1439-1505, 1544-1609, 1646-1711, 2006-2077, 2093-2219, 2006-2234 |
| *Shewanella* sp. SGI-i1615, pfaB | 144 | PF00698 | 347-650 |
| *Shewanella* sp. SGI-i1615, pfaC | 146 | PF02801, PF07977, PF07977, PF00109, PF00109 | 305-427, 1375-1509, 1827-1960, 8-297, 507-775 |
| *Shewanella* sp. SGI-i1615, pfaD | 148 | PF03060 | 88-363 |
| *Shewanella* sp. SGI-i1615, pfaE | 150 | PF01648 | 145-207 |

Example 2

Construction of Expression Cassettes Carrying the PUFA-PKS Systems of the Isolates *Shewanella* sp. SGI-i254 and *Shewanella* sp. SGI-i261 for Heterologous Expression in *E. Coli*

With the goal of demonstrating the functionality of the molecules identified as described above in a heterologous system, PUFA-PKS genes of the bacterial isolates *Shewanella* sp. SGI-i254 and *Shewanella* sp. SGI-i261 were cloned into a series of Duet vectors: pCDFDuet-1, pACYCDuet-1, pCOLADuet-1, and pETDuet-1 (Novagen). The Duet expression vectors are a set of compatible plasmids in which multiple target genes are cloned and co-expressed from the T7 inducible promoter in *E. coli*. The genes were cloned behind a T7/lac promoter and expression was induced by addition of isopropyl-β-D-thio-galactoside (IPTG, 1 mM) when *E. coli* cell cultures reached an optical density of about 0.5 at 600 nm.

The following gene sequences from the isolate *Shewanella* sp. SGI-i254 were cloned into the Duet vectors: pfaA (SEQ ID NO:1), pfaB (SEQ ID NO:3), pfaC (SEQ ID NO:5), pfaD (SEQ ID NO:7), and pfaE (SEQ ID NO:9). Each of the *Shewanella* sp. SGI-i254 gene sequences was amplified by PCR with Phusion DNA polymerase (New England Biolabs). Approximately 35 to 40 bp vector overlapping sequences were included on the ends of the PCR fragments so that they could be assembled into the vectors. The genes were assembled into the four Duet vectors according to the following: pfaA into pCDFDuet-1 NcoI-NotI site; pfaB into pACYCDuet-1 NcoI-NotI site and pfaD into pACYCDuet-1 NdeI-XhoI site; pfaC into pCOLADuet-1 NdeI-XhoI site; pfaE into pETDuet-1 NdeI-XhoI site. As a result, each of the ORFs was cloned behind a T7 promoter and *E. coli* Ribosomal Binding Site (RBS). The assembly reactions were performed with GIBSON ASSEMBLY™ Master Mix (New England Biolabs). The resulting Duet plasmid pCDFDuet-254 contained *Shewanella* sp. SGI-i254 pfaA in pCDFDuet-1; duet plasmid pACYCDuet-254 contained *Shewanella* sp. SGI-i254 pfaB and pfaD in pACYCDuet-1; duet plasmid pCOLADuet-254 contained *Shewanella* sp. SGI-i254 pfaC in pCOLADuet-1; and duet plasmid pETDuet-254 contained *Shewanella* sp. SGI-i254 pfaE in pETDuet-1. The four resulting expression constructs were introduced to NovaBlue(DE3) *E. coli* (Novagen) by co-transformation. The transformants were selected on LB agar supplemented with carbenicillin (15 ug/ml), chloramphenicol (17 ug/ml), kanamycin (25 ug/ml) and spectinomycin (25 ug/ml).

A similar strategy was used to create expression constructs containing the PUFA-PKS gene sequences derived from the *Shewanella* sp. SGI-i261 isolate. The resulting Duet plasmid pCDFDuet-261 contained *Shewanella* sp. SGI-i261 pfaA (SEQ ID NO:17) in pCDFDuet-1; duet plasmid pACYCDuet-261 contained *Shewanella* sp. SGI-i261 pfaB (SEQ ID NO:19) and pfaD (SEQ ID NO:21) in pACYCDuet-1; duet plasmid pCOLADuet-261 contained *Shewanella* sp. SGI-i261 pfaC (SEQ ID NO:23) in pCOLADuet-1; and duet plasmid pETDuet-261 contained *Shewanella* sp. SGI-i261 pfaE (SEQ ID NO:25) in pETDuet-1.

In addition, expression constructs containing the PUFA-PKS gene sequences derived from the *Vibrio* sp. SGI-i155 isolate were cloned in Duet vectors. The resulting suite of Duet plasmids contained *Vibrio* sp. SGI-i155 pfaA (SEQ ID NO:37) *Vibrio* sp. SGI-i155 pfaB (SEQ ID NO:39), *Vibrio* sp. SGI-i155 pfaD (SEQ ID NO:41); *Vibrio* sp. SGI-i155 pfaC (SEQ ID NO:43); and *Vibrio* sp. SGI-i155 pfaE (SEQ ID NO:45).

Example 3

Production of Polyunsaturated Fatty Acids in Recombinant *E. coli* Cells Expressing PUFA-PKS System from the Bacterial Isolates *Shewanella* Sp. SGI-i254

Duet plasmids pCDFDuet-254, pACYCDuet-254, pCOLADuet-254, and pETDuet-254, were transformed into *E. coli* strain NovaBlue(DE3), which contains an inducible promoter derived from T7 RNA polymerase gene.

Four independent *E. coli* colonies were picked from the plate and grown to a seed inoculum in 2 ml of LB supplemented with carbenicillin (15 ug/ml), chloramphenicol (17 ug/ml), kanamycin (25 ug/ml) and spectinomycin (25 ug/ml) at 30° C., transfer the seed culture to 40 ml fresh medium by adjusting the OD600 to 0.05, and incubated at 15° C. until the OD600 reaches 0.6 to 1.0. The expression of the SGI-i254 PKS genes were induced by adding 1 mM of isopropyl-β-D-1-thiogalactopyranoside (IPTG) and incubated the *E. coli* culture at 15 C for an additional 24 hours. Cells were harvested by centrifugation for fatty acid methyl ester (FAME) analysis. Upon cell growth and addition of IPTG, according to manufacturer's instructions (Novagen), production of EPA by recombinant *E. coli* cells was observed. Briefly, 1 mM IPTG was added for induction when cells reached an optical density of about 0.5 at 600 nm. The fatty acids were converted to methyl-esters using standard techniques. A summary of the FAME analyses is provided at TABLE 3. The EPA contents of the transformed *E. coli* cells was 6.2-6.4% of total fatty acids. No detectable EPA production was observed in control *E. coli* cells transformed with an empty transformation vector.

TABLE 3

Summary of FAME results from recombinant *E. coli* cells containing the PUFA-PKS pathway from the isolate SGI-i254. Four independent *E. coli* colonies containing the i254 PKS Pathway and two wild-type control colonies were assayed for their EPA contents in standard FAME analyses.

| Clone number | Total FA (μg) | % EPA | % DHA | EPA (μg) | DHA (μg) |
|---|---|---|---|---|---|
| 254-1 | 1775.6 | 6.3 | 0.0 | 112.2 | 0.0 |
| 254-2 | 1603.3 | 6.4 | 0.0 | 101.9 | 0.0 |
| 254-3 | 1990.4 | 6.3 | 0.0 | 125.0 | 0.0 |
| 254-4 | 1599.0 | 6.4 | 0.0 | 102.9 | 0.0 |
| Vector control-1 | 1867.8 | 0.0 | 0.0 | 0.0 | 0.0 |
| Vector control-2 | 1137.8 | 0.0 | 0.0 | 0.0 | 0.0 |

Example 4

Production of Polyunsaturated Fatty Acids in Recombinant *E. coli* Cells Expressing PUFA-PKS System from the Bacterial Isolate *Shewanella* sp. SGI-i261

Duet plasmids pCDFDuet-261, pACYCDuet-261, pCOLADuet-261, and pETDuet-261, were transformed into *E. coli* strain NovaBlue(DE3), which contains an inducible promoter derived from T7 RNA polymerase gene.

Four independent *E. coli* colonies were picked from the plate and grown to a seed inoculum in 2 ml of LB supplemented with carbenicillin (15 ug/ml), chloramphenicol (17 ug/ml), kanamycin (25 ug/ml) and spectinomycin (25 ug/ml) at 30° C., transfer the seed culture to 40 ml fresh medium by adjusting the OD600 to 0.05, and incubated at 15° C. until the OD600 reaches 0.6 to 1.0. The expression of the SGI-i261 PKS genes were induced by adding 1 mM of isopropyl-β-D-1-thiogalactopyranoside (IPTG) and incubated the E. coli culture at 15 C for an additional 24 hours. Cells were harvested by centrifugation for fatty acid methyl ester (FAME) analysis. Upon cell growth and addition of IPTG, according to manufacturer's instructions (Novagen), production of EPA by recombinant E. coli cells was observed. Briefly, 1 mM IPTG was added for induction when cells reached an optical density of about 0.5 at 600 nm. The fatty acids were converted to methyl-esters using standard techniques. A summary of the FAME analyses is provided at TABLE 4. The EPA contents of the transformed E. coli cells were ranging 1.9-2.9% of total fatty acids. No detectable EPA production was observed in control E. coli cells transformed with an empty transformation vector.

TABLE 4

Summary of FAME results from recombinant E. coli cells containing the PUFA-PKS pathway from the isolate SGI-i254. Four independent E. coli colonies containing the i254 PKS Pathway and two wild-type control colonies were assayed for their EPA contents in standard FAME analyses.

|  | Total FA (μg) | % EPA | % DHA | EPA (μg) | DHA (μg) |
|---|---|---|---|---|---|
| 261-1 | 2858.54 | 2.04 | 0.00 | 58.21 | 0.00 |
| 261-2 | 2640.87 | 1.94 | 0.00 | 51.18 | 0.00 |
| 261-3 | 3161.51 | 2.87 | 0.00 | 90.81 | 0.00 |
| 261-4 | 2593.90 | 1.91 | 0.00 | 49.45 | 0.00 |
| Vector control-1 | 1397.12 | 0.00 | 0.00 | 0.00 | 0.00 |
| Vector control-2 | 1617.59 | 0.00 | 0.00 | 0.00 | 0.00 |

The results presented above show that expression of the Shewanella PUFA-PKS pathways in recombinant E. coli can be used to modulate fatty acid profiles of recombinant host cell, which demonstrates that fatty acid profiles of host cells can be modulated by the nucleic acid molecules described herein.

In addition, the same methods were used to express the Vibrio sp. i155 PUFA-PKS genes in E. coli. The results of the FAME analysis are seen in TABLE 5. The EPA contents of the transformed E. coli cells were ranging 1.5-2.9% of total fatty acids. No detectable EPA production was observed in control E. coli cells transformed with an empty transformation vector.

TABLE 5

Summary of FAME results from recombinant E. coli cells containing the PUFA PKS pathway from the isolate SGI-i155. Four independent E. coli colonies containing the i155 PKS pathway and two wild-type control colonies were assayed for their EPA contents in standard FAME analyses.

| Clone Number | Total FA (ug) | % EPA | % DHA | EPA (ug) | DHA (ug) |
|---|---|---|---|---|---|
| 155-1 | 1548.3 | 2.9 | 0.00 | 45.2 | 0.0 |
| 155-2 | 1231.6 | 1.7 | 0.00 | 21.4 | 0.0 |
| 155-3 | 1507.3 | 1.9 | 0.00 | 29.1 | 0.0 |
| 155-4 | 1412.4 | 1.5 | 0.00 | 21.6 | 0.0 |
| Vector control-1 | 1397.1 | 0.0 | 0.0 | 0.0 | 0.0 |
| Vector control-2 | 1593.7 | 0.0 | 0.0 | 0.0 | 0.0 |

Example 5

Construction of Expression Vectors Carrying Codon-optimized PUFA-PKS Genes for Heterologous Expression in Chytrids Gene sequences encoding pfaA, pfaB, pfaC, pfaD, and pfaE of the Shewanella sp. isolate SGI-i254 were each codon-optimized for expression in a host chytrid cell line, Aurantiochytrium sp. NRRL-50835, chemically synthesized (SGI-DNA, La Jolla, Calif.), and cloned into suitable transformation vectors to generate expression plasmids by using Gibson DNA assembly method (GIBSON ASSEMBLY™, Nature Methods, 7,901-903, 2010). Oligonucleotide primers used for GIBSON ASSEMBLY™ cloning are also provided herein in the Sequence Listing.

pSGI-JU-206 is a construct carrying the Nourseothricin resistance marker, nat, for the heterologous expression of codon-optimized i254pfaA-co886 (SEQ ID NO:11) in chytrids. pSGI-JU-206 was generated in two steps. First, plasmid pSGI-JU-206.1 was generated by amplifying the codon-optimized i254pfaA-co886 gene with primers oSGI-JU-898 and oSGI-JU-899, digesting with BstBI and NotI and cloning into the same restriction sites of pSGI-JU-174. This digestion of pSGI-JU-174 resulted in a vector such that after ligation, an alpha-tubulin promoter from chytrid isolate SGI-i886 (i.e. Aurantiochytrium sp. NRRL-50835) (SEQ ID NO:194) and a PGK1 terminator sequence from Saccharomyces cerevisiae (Leandro et al., Microbiology Vol. 154 No. 6 1646-1655, 2008) were introduced to the 5' and 3' of the insert, respectively. pSGI-JU-174 also carries the Nourseothricin resistance marker, nat. However, the digestion with BstBI resulted in removal of 2-kb of sequence at the 5' end of the gene; thus, as a second step, this region was amplified with primers oSGI-JU-898 and oSGI-JU-1004 and cloned by GIBSON ASSEMBLY™ method into the BstBI site of pSGI-JU-206.1. PCR-derived insert sequences were all confirmed by Sanger sequencing.

pSGI-JU-207 is a construct carrying the Paromomycin resistance marker, nptII, for the heterologous expression of codon-optimized i254pfaD-co886 (SEQ ID NO:14) in chytrids. The i254pfaD-co886 gene was first amplified using primers oSGI-JU-905 and oSGI-JU-901. oSGI-JU-905 introduced a silent mutation to remove a SbfI site that was present near the 5' end of the synthesized gene. This PCR product was used as a template to amplify the full length i254pfaD-co886 using primers oSGI-JU-900, oSGI-JU-904 and oSGI-JU-901. In this reaction, oSGI-JU-904 was at 1/100 the concentration of the other two primers and was used to extend the template to the start codon of the gene which allows for oSGI-JU-900 to anneal and amplify the gene. The resulting product was cloned via GIBSON ASSEMBLY™ method into pSGI-JU-161 that was pre-digested with BstBI and NotI. This digestion of pSGI-JU-161 results in a vector such that after assembly, the SGI-i886 alpha-tubulin promoter and the PGK1 terminator sequence from Saccharomyces cerevisiae were introduced to the 5' and 3' of the insert, respectively. pSGI-JU-161 also carried the Paromomycin resistance marker, nptII. PCR-derived insert sequences were all confirmed by Sanger sequencing.

pSGI-JU-208 is a construct carrying the Hygromycin B resistance marker, hph, for the heterologous expression of codon-optimized i254pfaE-co886 (SEQ ID NO:15) in chytrids. The i254pfaE-co886 gene was amplified using primers oSGI-JU-902 and oSGI-JU-903. The resulting product was cloned via GIBSON ASSEMBLY™ into pSGI-JU-163 that was pre-digested with BstBI and NotI. This digestion of pSGI-JU-163 resulted in a vector such that after assembly, the SGI-i886 alpha-tubulin promoter and the PGK1 terminator sequence from *Saccharomyces cerevisiae* were introduced to the 5' and 3' of the insert, respectively. pSGI-JU-163 also carried the Hygromycin B resistance marker, hph. PCR-derived insert sequences were all confirmed by Sanger sequencing.

pSGI-JU-209 is a construct carrying the Paromomycin resistance marker, nptII, for the heterologous expression of codon-optimized i254pfaB-co886 (SEQ ID NO:12) and codon-optimized i254pfaD-co886 (SEQ ID NO:14) in chytrids. This plasmid was generated by assembling an alpha-tubulin promoter from chytrid isolate *Schizochytrium* sp. SGI-i94 (SEQ ID NO:197), the i254pfaB-co886 and the *S. cerevisiae* ENO2 terminator into the SbfI site of pSGI-JU-207 (described above). The SGI-i94 alpha-tubulin promoter was amplified from genomic DNA of the chytrid isolate SGI-i94 using primers oSGI-JU-785 and oSGI-JU-786. The i254pfaB-co886 was amplified using primers oSGI-JU-906 and oSGI-JU-907. The ENO2 terminator originated from genomic DNA of *S. cerevisiae* CEN.PK2 (EUROSCARF, Germany) and was amplified using primers oSGI-JU-781 and oSGI-JU-782. PCR-derived insert sequences were all confirmed by Sanger sequencing.

pSGI-JU-210 is a construct carrying the Hygromycin B resistance marker, hph, for the heterologous expression of codon-optimized i254pfaC-co886 (SEQ ID NO:13) and codon-optimized i254pfaE-co886 (SEQ ID NO:15) in chytrids. This plasmid was generated by assembling the *Schizochytrium* sp. SGI-i94 alpha-tubulin promoter (SEQ ID NO:197), the i254pfaC-co886 coding sequence, and the *S. cerevisiae* ENO2 terminator into the SbfI site of pSGI-JU-208 (described above). The i254pfaC-co886 was amplified using primers oSGI-JU-908 and oSGI-JU-909. The ENO2 terminator originated from genomic DNA of *S. cerevisiae* CEN.PK2 (EUROSCARF, Germany) and was amplified using primers oSGI-JU-781 and oSGI-JU-782. PCR-derived insert sequences were all confirmed by Sanger sequencing.

Example 6

Construction of Recombinant Chytrid Strains GH-SGI-F-06762 and GH-SGI-F-06763 Expressing a Codon-Optimized i254 PUFA-PKS Pathway Chytrid Transformation:

Approximately 10 µL of Chytrid cells were taken off of plate and resuspended in 1 mL of FM002 (17 g/L Instant Ocean, 20 g/L glucose, 10 g/L Yeast extract, 10 g/L Peptone). Ten microliters of this suspension was used to inoculate 50 mL of FM002 in a baffled 250 mL flask. This culture was incubated in an orbital shaker at 30° C. and 150 rpm. The following morning (~20 hours), the mid-growth phase cells were collected (2000×g for 5 min) and resuspended in 20 mL 1M Mannitol (pH 5.5) and transferred to a 125 mL flat bottom flask. The cells were enzyme treated by addition of 200 µL of 1M CaCl2 and 500 µL of 10 mg/mL protease XIV and incubated for 4 hours in an orbital shaker at 30° C. and 100 rpm. Cells were collected in round-bottom tubes and washed with an equal volume of cold 10% glycerol. The cells were then resuspended with 4× pellet volume of Ingenio® electroporation solution (Mirus Bio LLC; Madison, Wis.). 100 µL of cells were mixed with DNA in a pre-chilled 0.2 cm electroporation cuvette and electroporated (200 Ω, 25 µF, 700 V). Immediately after electroporation, 1 mL of GY media (17 g/L Instant Ocean, 30 g/L glucose, 10 g/L yeast extract) was added and cells were transferred to a round-bottom snap-cap tube and recovered over-night at 30° C. with shaking (150 rpm). The recovered cells were then plated onto appropriate selection plates.

Construction of Chytrid Strains GH-SGI-F-06762 and GH-SGI-F-06763 Expressing a Codon Optimized i254 PUFA-PKS Pathway As the first step of constructing a chytrid strain expressing the codon optimized i254 PKS pathway, the wild-type chytrid isolate WH-SGI-F-06267 was transformed with pSGI-JU-206, a construct for the heterologous expression of codon-optimized i254pfaA-co886 gene. For this purpose, pSGI-JU-206 was linearized by digestion with AhdI. Chytrid transformants were selected on FM001 (FM002 solidified with 15 g/L Bacto-agar) media containing Nourseothricin (1 g/L). Twenty-four transformants were screened for the presence of the full ORF of i254-pfaA-co886 by PCR using 5 primer pairs that amplify overlapping regions covering the entire ORF. Fourteen of the 24 transformants were determined to contain the entire i254-pfaA-co886 ORF.

Expression Analysis qRT-PCR experiments were carried out to examine the expression of the codon-optimized i254pfaA-co886 transgene in the 14 transformants selected as described above. These transformants/cell lines and wild-type WH-SGI-F-06267 were grown to mid-growth phase in 50 mL FM002 then collected and resuspended in 10 mL of fresh FM002 media, with glucose increased to a final concentration of 40 g/L, at an $OD_{740}$ of 1.4. Six mL of this suspension was transferred to a well in a micro-24 plate (central vent type) and cultured at 30° C., 650 rpm, dissolved oxygen (DO) of 10%, pH control OFF, environment temperature at 28° C. After 23 hours, cells from 3 mL of culture was collected, homogenized with 1 mL TRIzol® (Life Technologies) and frozen at −80° C. Total RNA was prepared from this suspension using Direct-Zol™ RNA MiniPrep kit (Zymo Research Corp., Irvine, Calif.). 5 µg of total RNA was treated with RNase-free DNAse I (New England Biolabs, Cat # M0303) and column purified using RNA Clean & Concentrator™ (Zymo Research Corp., Irvine, Calif.). One fifth of this eluate was used to synthesize cDNA using qScript cDNA SuperMix (Quanta Biosciences, Gaithersburg, Md.). qPCR was carried using nuPCR Mastermix (Illumina®) and the CFX96 Touch™ Real-Time PCR Detection System (Bio-Rad Labs, Hercules, Calif.). Expression of a house keeping gene, SG2EUKT116641, was used as an internal control to normalize gene expression because it had been previously identified from internal transcriptomics analyses as a transcript whose level appeared to remain relatively constant across growth conditions and growth stages. Relative normalized expression (ΔΔCq) was calculated using Bio-Rad CFX Manager 3.0 (Bio-Rad). The relative normalized expressions for the i254-pfaA-co886 gene in the 14 transformants are shown in FIG. 3. All transgenic chytrid lines exhibited expression of i254-pfaA-co886 transgene while the parent isolate WH-SGI-F-06267 did not. Of these, recombinant chytrid lines 4, 7 and 13 were designated as GH-SGI-F-06843, GH-SGI-F-06844, and GH-SGI-F-06845, respectively.

To introduce the remaining codon optimized genes of the i254 PUFA-PKS pathway, the recombinant lines GH-SGI-F-06843 and GH-SGI-F-06845 were transformed with the following two plasmids: (1) a PciI pre-digested pSGI-JU-209 plasmid that carried the codon-optimized i254pfaB-co886 gene and codon-optimized i254pfaD-co886 gene; and (2) an FspI pre-digested pSGI-JU-210 plasmid that carried the codon-optimized i254pfaC-co886 gene and the codon-optimized i254pfaE-co886 gene. Transformants were selected on FM001+Nourseothricin (1 g/L)+Paromomycin (2 g/L)+Hygromycin B (2 g/L). Transformants were then examined for the presence of full length PUFA-PKS genes by colony PCR using overlapping PCR products. Based on this analysis, 9 and 6 chytrid transformants derived from GH-SGI-F-06483 and GH-SGI-F-06485, respectively, were identified as carrying the complete codon optimized i254 PUFA-PKS pathway. Two of the resulting triple-transformed strains derived from GH-SGI-F-06483 and one of the triple-transformed strains derived from GH-SGI-F-06485 were designated as GH-SGI-F-06762, GH-SGI-F-06763, and GH-SGI-F-06764, respectively.

Example 7

Production of Eicosapentaenoic Acid (EPA) by Heterologous Expression in Chytrid Cells of a Codon-optimized PUFA-PKS Pathway Derived from Bacterial Isolate SGI-i254

To determine if recombinant chytrid strains carrying the codon optimized i254 PUFA-PKS pathway (i.e. GH-SGI-F-06762, GH-SGI-F-06763, and GH-SGI-F-06764) were capable of producing higher EPA contents relative to that in the wild-type strain WH-SGI-F-06267, EPA levels in these strains were measured during mid-growth phase. Cells of the three recombinant chytrid lines and wild-type control were grown overnight at 30° C. with shaking velocity at 150 rpm. The culture was diluted to an OD740=0.1 in fresh FM002 and grown at 30° C. with shaking at 150 rpm. After 8 hours, cells were collected for GC-FAME analysis. A graphical summary of the results of fatty acid analyses is provided at FIG. 4. The recombinant strains GH-SGI-F-06762, GH-SGI-F-06763, and GH-SGI-F-06764, each containing the codon-optimized i254 PUFA-PKS pathway accumulated higher levels of EPA relative to % total FAME, compared to the wild-type strain WH-SGI-F-06267. This result demonstrates that PUFA profiles of chytrid host cells can be modulated by the nucleic acid molecules described herein.

In a separate experiment, recombinant chytrid strains carrying the native PUFA-PKS genes from i254 (i.e. codon usage was not optimized for chytrid expression) or the codon-optimized i254 PUFA-PKS genes were tested for EPA production during growth at 15° C. Three strains carrying the codon-optimized i254-co886 genes were found to produce slightly higher EPA levels after the initial growth stage at 30° C.

A number of embodiments of the invention have been described. Nevertheless, it will be understood that elements of the embodiments described herein can be combined to make additional embodiments and various modifications may be made without departing from the spirit and scope of the invention. Accordingly, other embodiments, alternatives and equivalents are within the scope of the invention as described and claimed herein.

Headings within the application are solely for the convenience of the reader, and do not limit in any way the scope of the invention or its embodiments.

All publications and patent applications mentioned in this specification are herein incorporated by reference to the same extent as if each individual publication or patent application was specifically can individually indicated to be incorporated by reference.

SEQUENCE LISTING (174 sequences)

SEQ ID NO: 1 - DNA, 8199 bp, Shewanella oneidensis
  misc_feature: SGI cDNA ID NO. 1261955F
  misc_feature: PfaA gene
  misc_feature: Encodes the peptide sequence at SEQ ID NO 2
  misc_feature: Useful for modulating production of PUFA
atgagccaatccagtcatcaagataaacgcctcaacaagcgcttaaaagacatgcctgtcgccatcgtcggtatggcgagcatatttgccaattcgcgttacctgaataaattttgggatttaatcagcgaaaaaatcgatgccattgtcgatattccagacagtcactggaacgccgacgattactacgatgccgataaatctgcgccagataaaagctattgtaagcgtggcggttttttacctgaagttgatttcaatccaatggaatttggcctgccgcctaatattttagaattaacagacacctcgcaattattgtcattggtcgttgccaaagaagtgttagccgacgcaggcgttgatgcacaatacgataccgaccgcatcggtatcacccttggtgtgggcggcggccaaaaaattaaccacagtttaagcagtcgcttgcaatacccggtactaaaaaaagtattcaaaaacagcgggattagtgacgcagacagcgaaatgctgattaaaaagtttcaagaccaatatatccactgggaagaaaattcattcccggggtcgcttggcaacgtaattgctgggcgtattgctaaccgttttgacctaggcggcatgaactgtgttgtcgatgccgcttgtgcaggctcacttgctgccatgcgtatggcgattaccgaactggttgaagggcgcagtgacatgatgatcactggcggtgtgtgtaccgacaactcgccgtcaatgtacatgagcttttcaaaaaccccagcgtttaccactaacgacactatccaaccttttgatatcgactcaaaaggcatgatgatcggcgaaggtattggcatgatcgccataaagcgccttgacgatgctgaacgtgatggcgataaaatttatgcggtaattaaaggtattggctcatcatctgacggtaaatttaagagcatttatgctccaaggccagaaggccaagctaaagcattaaaacgcgcttatgacgacgcaggctttgcgccgcacactgtcggccttattgaagcgcacggtacaggcaccgcagcaggtgatgtggctgagtttaacggcttaaagtcagtatttgctgaagataatgacgcccaacagcatattgcacttggctcggtaaagtctcaagtcggtcacactaagtctaccgctggcacagccggagtcattaaagtggccttggcgttgcaccacaaagtattgccaccaacgattaacgtcagcaaaccacaccctaaactgagcatcagtgattcaccgttttatcttaataccgaaacgcgtccttggttacctcgccctgacgacactccacgcagagcaggtatcagctcgtttggctttggtggcactaacttccacattgtattagaagaatatcgccaagatcatgcccgcaatgacaaatatcgtcaacgcacggtgccgcaaagcttgctgataagtgcagataacaaggctgaactgcaaggtaaactgactcaattgctaacagagattaatgcgattgatatcagccaggcgaacgcccaagagttggcactgcaaaaacttgggcaacgttttgctatttctcaagttgcgccaacatcggcccaattaggcctagttgtggcctcaattgccgacctaactgtgcagctcacacaagcccttaaccagttaaccaacaatgatgccgataactggcaattaccctctggcgcaagttatcgcagtgcaagtttaggcgataacaataccccacctaaggtggcggccttgtttgcaggccaaggggcacaatacgttaacatggcgactgagcttgcgtgtttttaccctgaaatgcgccagcagttaatgcaggcagacaaggtgtttgcccagcataaacaaacgccattgtcgcaaattatgtaccctattccggcttttgaagcacaagacattgccgcacaacaagcggcactaaccaatactgcttatgcccaaagcgccattggtgccgtcagcatgggccaatatgcactattcactcaagctggttttagccctgacatggtcgccggccacagttttggtgagctatctgccttgtgtgcagcgggggtgattagccaagctgattattatcaattggcctttgctcgcggtcaggccatggctgccacgcccgccgatcaagaccctggcgccatgtacgccattattgtgccgccacaagcaactgagcaaggtgtaaaccagcttgaaagctgtattagtgcctttgatggcgtaaaagtggctaactacaatgcaccaacacaattggtgattgcaggcccaacagaagcttgcgcagaggcagctaaagccgttactgctgagttagggtttaaagccattgcattgccggtatcaggtgcattccatacaccattagtgggccatgctcagcagccttttgctaaggccattagcaaggttaaatttgctaagcctaaagtgacgttgttcgccaacggtactggcaagctttacccaagtaatggtaaagccattcaaaccgcctttagcgagcatatgctgcagtcggtacgctttagtgagcaattggttgccatgtatgacgctggcgcccgagtatttgttgagtttgggccaaaaaatattttacaaaaactggttgaggcaacgttaggtaacaagccagaaactgtcagtgttgttagcctaaaccctaaccctaaaggcagcagtgatactcaattacgccaagctgcaatccaattagcagtattaggtttaccactgtctgaggtggatccttaccaagcacctatagcagagctgaccaacgtgtcgccaatgaacgttaagctgacagcacaaaactacatcagccctgccacccaaagtaaaatgcaaaaatcattacaacaaggccaagtaaccagtaagacggtggaagtgcctgttgagaaaattgtggaaaaaatagtggaaaaacaagtgatcaaaaccgaatatgttgaagtgccgagtacgcctgcagcatctgcgcaagcgcctgttgctcaagcgactacagcacagccagcacacgcgagtcaaacaagcgcacaagctaataacgccgtcagcaatgacagtttaagtgctttttttgccgcccagcaacaagccgcgatgttgcatcagcagtttttagccattcctcaacaatatggcgatacgtttaatagcttgatgacagcccaggcacaaatggcatcatctggagttgcgatcccagaaagcttgcaacgttcgatggagttattccaccagcatcaggcgcaaaccctgcaaagccacacccaatttttaacgctacaggcgcaaacgagtcaggcagcattggcaatgttacaaggacaagcatctgcaacccctgcaccgacgcttaccaatacccttgcagctcaacagatggtagcagcgccccaaacacccgtgatgactcaagctgcgccagcgccagtgactccagagtctattgctcaggtcgcccaacctacagccgttaacagtgcatcaacaggtttatcagcagaaaccgtgcagctaaccatgatgacagtagtagccgataaaaccggttacccaaccgaaatgcttgaacttagcatggacatggaagccgatttaggtatcgattcaatcaagcgcgtggagattttaggcacagtgcaagatgaattgccgggcctgcctgaactcagcccagaagatttagccgagtgtcgcacattgggcgagattgtagattacatgcaatcaaccctatcagcctcaactgcgtcagcagcagttcaagcgccaacaatgcaaacaacacccgctcaaacatctgtgccaacatcaggcttaagcgcacaaactgtgctcaataccatgatgacagtcgtggccgataaaaccggttacccagccgaaatgctcgagctcaccatggacatggaagccgatttaggtatcgattcaatcaagcgcgtggagattttaggcacagtgcaagatgaattgccgggcttacctgaactcagcccagaagatttagccgagtgtcgcaccctaggcgagattgttgattacatgcaatcaaccttatcagcctcaactgcgtcaggagcttcaacttcgtcagcagcgcaaacaacgcaatcaacacccgctcaaacagcagcaccaacatcaggcttaagcgcacaaacagtgctcaataccatgatgacagtcgtggccgataaaaccggttacccagccgaaatgctcgagctcaccatggacatggaagccgatttaggtatcgattcaatcaagcgcgtggagattttaggcacagtgcaagatgaattgccgggcttacctgaacttagcccagaggatttagctgagtgtcgcaccctaggcgagattgtagattacatgcaatctaccttgtcagcttcagctgcgtcagcatcgccagtgaatgcagctgtccaagcgtctaataaaacatcagcgccaacatcagtgccaacatcaggcttaagcgcacaaaccgtgcagctaaccatgatgacagtcgtggccgataaaaccggttacccaaccgaaatgcttgaacttagcatggacatggaagccgatttaggcatcgattcaatcaagcgcgtggagattttaggcacagtgcaagatgaattgccgggcttgcctgaactcaatccagaagatttggccgagtgccgcaccctaggtgagattgtagattacatgcaatctaccttgtcagcttcaactgcgtcagcatcgccagtgaatgcagctgtccaagcatctaataaaacatcagcgccaacatcagtgccaacatcaggcttaagcgcacaaaccgtgcagctaaccatgatgacagtcgtggccgataaaaccggttacccaaccgaaatgcttgaacttagcatggacatggaagccgatttaggcatcgattcaatcaagcgcgtggagattttaggcacagtgcaagatgaattgccgggcttgcctgaactcaatccagaagatttggccgagtgccgcaccctaggtgagattgtagattacatgcaatctaccttgtcagcttcaactgcgtcagcatcgccagtgaatgcagctgtccaagcatctaatcaaacatcagctccaacatcattgtcaacatcaggcttaagcgcacaaactgtgcttaataccatgatggcagtagtagccgataaaaccggttacccagccgaaatgctcgagctcaccatggacatggaagctgatttgggtatcgactcaatcaagcgcgtcgagattttaggcacagtacaagatgaattgccgggtttaccagaactcaacccggaagatttggccgagtgccgcacattgggcgaaatcgtcagctatatgcaaggtcaactcggcatgcctgctgcgagcatcactactgcgccaacgccaacccctgtcgacacatcagcattaccaccacacagtggggtcgcgctaaaaaagttgccagcggcggataaactagaagcatgttattcaacagacagctgcattgtcataacagatgacggtcataatgccggtgtacttgctgaaaaactccatgccaaaggcttaaccgtcgctgttattcgcaatccagacaccatcagcgttgctcactcaccattaagcagcgacattagcagctatacacttagcagcattgatgatgccgaaattgccaaggtcattaaggcaattacggcaacgcaccctattgcgggctttgtgcatttacaaccgcagtttaacgcaaacagcaaagatttagtcagttgcaatgtggcagcaaaagctgctgttgataacgcctttttgtgggcgaaacatctgcatactgaattttcaaaaccactgcaatcacgcttaagttacgtgaccgtaagccgtattgatggtggctttggctaccttaatagcgcagcactcagcaaagcagaattaaaccaagcagccttgtctgggctaaccaaaacactaagccatgaatggccaaatgtattttgccgcgcgcttgatatcgccaatgacattgacgccaaaacctttgccaatgccattattgctgagctgtttgatgttaatgctgcagcgcccaatgctaaacggcttaccgaagtgggcatcagcccgcaagggcgcgcaacattggttgcagcaaaaaacaacacctcgcactaccctgctgtagtgttaacccaacaagacacgctattagtcactggtggcgcaaaaggtgtcacgtttgaatgtgcactcaccttagccaagcaatgccaatcgcactttgtactcgccggtcgcagtcagcacctaggtaaagacatgccagcttgggcccaaggcaaacaagcctcagagcttaaagctgccgccattagttacattcaatcccaaggcgaaaaacccacaccaaagcaaattgatgccttagtgtggccagtacaaagtagcttagagattgaccgtgccttaagcgcatttactgaagtgggcgccagtgcccaatatgtggcaatggatgttagcaacccagatgccgttaaagccgcacttgcagcattaaccgatactaacggtaaaaaccgagtcatcaatggcgtcattcatggcgcgggggtattggcagataaacacattcaagacaaaacattggacgaactaaatcgggtgtacagcactaaggtgactggcgtagcaagtatcattaacgcacttgatccacagcacatcaagttagtcgctatgttctcgtcggcggcggggttttatggcaacacaggtcaaagcgactatgcgatgtcgaatgaaattctcaataaaaccgcattaaaattggccgcccaattaccccaagccaaagtcatgagctttaactggggcccgtgggatggtggcatggtgagctcagcgctgaaaaagatgtttgttgaacgtggtgtttacgtaattccactgcaagcaggcgctaacttatttgctcacagcttattaagctcgcaaagcgtgcagatgctaattggttcagacatgcaaggctcggccacacaggacacaactgcaaaaaagcctaatgcgaacactttgccacacgcagagggttcgctgacgttttctgcgccttattgggctgctgacacccaaaccgttacggtgactcgggtactgcaacctaatgagcttgtatttgtaaacgatcaccgcattgccggcaacccagtgttgccaacagtgtgtgcgattcagtggatgcgagaaaccgcgcaaaccttgtgccatgtgccagtgagtattgctgactataaattgcttaaagggattatttttgacaccgaccaagcccatttactgcaactgcaactcacccaaactggcgcgggcttgaacgcgctaatctcaagcagggcgttaaatgagccagacgcagcgatgaagccacaatatcaagcaacattagtcgtcaatgacgcgctaacgcccaccgcggttgctcagtcatcgttaccggcaaccgtgctgcaaaagctcgcgcaggtacccgcaatacacgctggcaacaccttgtatcaaaatggcaccttgttccatgggccgcgcttgcagggtattaagcaagtattgagctttgatgatgagcaactggtgtgtcaggttaagttagcgcaaattaaccctaacgactgcccaggctttgcaccgtcggcagtgtccggtggtagccaaatatttgccgaagacttgctattgcaggccatgttggtttgggcaaggcttaaatacgatgccgccagtttgccatcatcaatggggcaatttatcactgtggcaccatttgctagcggcgatcagggctacattcaacttgaggtgataaaacacagcggcagaatgctcgtggccaatgtgagcttgtaccatcaagatggacgtttaagctgtcaaatgcgtgaggctaaaatcaccattagcaaaacgctgaatcaggcctttattaatcagcatgagaatcagcatgagaatcagcatgagaatgagcatgagaatcagcctgcaaaccagcacagcaaggatagtgtgtga

SEQ ID NO: 2 - protein, 2732 aa, Shewanella oneidensis
  misc_feature: SGI Peptide ID NO. 1261955
  misc_feature: PfaA polypeptide
  misc_feature: PfaA polypeptide
  misc_feature: Useful for modulating production of PUFA
  misc_feature (1)..(1418): NCBI GI: 91793978 Blast Desc: beta-ketoacyl synthase [Shewanella denitrificans OS217] gi|91715980|gb|ABE55906.1| beta-ketoacyl synthase [Shewanella denitrificans OS217]
  misc_feature (5)..(1418): NCBI GI: 152999951 Blast Desc: erythronolide synthase [Shewanella baltica OS185] gi|151364569|gb|ABS07569.1| Erythronolide synthase [Shewanella baltica OS185]
  misc_feature (5)..(1391): NCBI GI: 336310880 Blast Desc: omega-3 polyunsaturated fatty acid synthase subunit, PfaA [Shewanella sp. HN-41] gi|335865560|gb|EGM70576.1| omega-3 polyunsaturated fatty acid synthase subunit, PfaA [Shewanella sp.
  misc_feature (5)..(1418): NCBI GI: 217974087 Blast Desc: polyketide-type polyunsaturated fatty acid synthase PfaA [Shewanella baltica OS223] gi|217499222|gb|ACK47415.1| polyketide-type polyunsaturated fatty acid synthase PfaA baltica
  misc_feature (5)..(1418): NCBI GI: 304409535 Blast Desc: polyketide-type polyunsaturated fatty acid synthase PfaA [Shewanella baltica OS183] gi|304352053|gb|EFM16451.1| polyketide-type polyunsaturated fatty acid synthase PfaA baltica
  misc_feature (5)..(1418): NCBI GI: 126173663 Blast Desc: beta-ketoacyl synthase [Shewanella baltica OS155] gi|125996868|gb|ABN60943.1| beta-ketoacyl synthase [Shewanella baltica OS155] gi|334862821|gb|AEH13292.1| polyketide-type fatty
  misc_feature (5)..(1418): NCBI GI: 160874571 Blast Desc: polyketide-type polyunsaturated fatty acid synthase PfaA [Shewanella baltica OS195] gi|160860093|gb|ABX48627.1| polyketide-type polyunsaturated fatty acid synthase PfaA baltica
  misc_feature (5)..(1418): NCBI GI: 206570564 Blast Desc: PfaA [Shewanella sp. BR-2]
  misc_feature (5)..(1418): NCBI GI: 120599574 Blast Desc: erythronolide synthase [Shewanella sp. W3-18-1] gi|120559667|gb|ABM25594.1| Erythronolide synthase [Shewanella sp. W3-18-1]
  misc_feature (5)..(1418): NCBI GI: 146292429 Blast Desc: erythronolide synthase [Shewanella putrefaciens CN-32] gi|145564119|gb|ABP75054.1| Erythronolide synthase [Shewanella putrefaciens CN-32]
  misc_feature (18)..(295): Pfam Id: PF00109 Pfam Desc: Beta-ketoacyl synthase, N-terminal domain
  misc_feature (303)..(420): Pfam Id: PF02801 Pfam Desc: Beta-ketoacyl synthase, C-terminal domain
  misc_feature (601)..(928): Pfam Id: PF00698 Pfam Desc: Acyl transferase domain
  misc_feature (1208)..(1273): Pfam Id: PF00550 Pfam Desc: Phosphopantetheine attachment site/acyl carrier protein
  misc_feature (1315)..(1381): Pfam Id: PF00550 Pfam Desc: Phosphopantetheine attachment site/acyl carrier protein
  misc_feature (1426)..(1492): Pfam Id: PF00550 Pfam Desc: Phosphopantetheine attachment site/acyl carrier protein
  misc_feature (1538)..(1603): Pfam Id: PF00550 Pfam Desc: Phosphopantetheine attachment site/acyl carrier protein
  misc_feature (1649)..(1714): Pfam Id: PF00550 Pfam Desc: Phosphopantetheine attachment site/acyl carrier protein
  misc_feature (1759)..(1824): Pfam Id: PF00550 Pfam Desc: Phosphopantetheine attachment site/acyl carrier protein
  misc_feature (2110)..(2175): Pfam Id: PF00106 Pfam Desc: short chain dehydrogenase
  misc_feature (2110)..(2338): Pfam Id: PF08659 Pfam Desc: Ketoreductase domain (KR)
  misc_feature (2198)..(2323): Pfam Id: PF00106 Pfam Desc: short chain dehydrogenase
  misc_feature (2418)..(2693): Pfam Id: PF14765 Pfam Desc: polyketide synthase dehydratase domain (PS-DH)
MSQSSHQDKRLNKRLKDMPVAIVGMASIFANSRYLNKFWDLISEKIDAIVDIPDSHWNADDYYDADKSAPDKSYCKRGGFLPEVDFNPMEFGLPPNILELTDTSQLLSLVVAKEVLADAGVDAQYDTDRIGITLGVGGGQKINHSLSSRLQYPVLKKVFKNSGISDADSEMLIKKFQDQYIHWEENSFPGSLGNVIAGRIANRFDLGGMNCVVDAACAGSLAAMRMAITELVEGRSDMMITGGVCTDNSPSMYMSFSKTPAFTTNDTIQPFDIDSKGMMIGEGIGMIAIKRLDDAERDGDKIYAVIKGIGSSSDGKFKSIYAPRPEGQAKALKRAYDDAGFAPHTVGLIEAHGTGTAAGDVAEFNGLKSVFAEDNDAQQHIALGSVKSQVGHTKSTAGTAGVIKVALALHHKVLPPTINVSKPHPKLSISDSPFYLNTETRPWLPRPDDTPRRAGISSFGFGGTNFHIVLEEYRQDHARNDKYRQRTVPQSLLISADNKAELQGKLTQLLTEINAIDISQANAQELALQKLGQRFAISQVAPTSAQLGLVVASIADLTVQLTQALNQLTNNDADNWQLPSGASYRSASLGDNNTPPKVAALFAGQGAQYVNMATELACFYPEMRQQLMQADKVFAQHKQTPLSQIMYPIPAFEAQDIAAQQAALTNTAYAQSAIGAVSMGQYALFTQAGFSPDMVAGHSFGELSALCAAGVISQADYYQLAFARGQAMAATPADQDPGAMYAIIVPPQATEQGVNQLESCISAFDGVKVANYNAPTQLVIAGPTEACAEAAKAVTAELGFKAIALPVSGAFHTPLVGHAQQPFAKAISKVKFAKPKVTLFANGTGKLYPSNGKAIQTAFSEHMLQSVRFSEQLVAMYDAGARVFVEFGPKNILQKLVEATLGNKPETVSVVSLNPNPKGSSDTQLRQAAIQLAVLGLPLSEVDPYQAPIAELTNVSPMNVKLTAQNYISPATQSKMQKSLQQGQVTSKTVEVPVEKIVEKIVEKQVIKTEYVEVPSTPAASAQAPVAQATTAQPAHASQTSAQANNAVSNDSLSAFFAAQQQAAMLHQQFLAIPQQYGDTFNSLMTAQAQMASSGVAIPESLQRSMELFHQHQAQTLQSHTQFLTLQAQTSQAALAMLQGQASATPAPTLTNTLAAQQMVAAPQTPVMTQAAPAPVTPESIAQVAQPTAVNSASTGLSAETVQLTMMTVVADKTGYPTEMLELSMDMEADLGIDSIKRVEILGTVQDELPGLPELSPEDLAECRTLGEIVDYMQSTLSASTASAAVQAPTMQTTPAQTSVPTSGLSAQTVLNTMMTVVADKTGYPAEMLELTMDMEADLGIDSIKRVEILGTVQDELPGLPELSPEDLAECRTLGEIVDYMQSTLSASTASGASTSSAAQTTQSTPAQTAAPTSGLSAQTVLNTMMTVVADKTGYPAEMLELTMDMEADLGIDSIKRVEILGTVQDELPGLPELSPEDLAECRTLGEIVDYMQSTLSASAASASPVNAAVQASNKTSAPTSVPTSGLSAQTVQLTMMTVVADKTGYPTEMLELSMDMEADLGIDSIKRVEILGTVQDELPGLPELNPEDLAECRTLGEIVDYMQSTLSASTASASPVNAAVQASNKTSAPTSVPTSGLSAQTVQLTMMTVVADKTGYPTEMLELSMDMEADLGIDSIKRVEILGTVQDELPGLPELNPEDLAECRTLGEIVDYMQSTLSASTASASPVNAAVQASNQTSAPTSLSTSGLSAQTVLNTMMAVVADKTGYPAEMLELTMDMEADLGIDSIKRVEILGTVQDELPGLPELNPEDLAECRTLGEIVSYMQGQLGMPAASITTAPTPTPVDTSALPPHSGVALKKLPAADKLEACYSTDSCIVITDDGHNAGVLAEKLHAKGLTVAVIRNPDTISVAHSPLSSDISSYTLSSIDDAEIAKVIKAITATHPIAGFVHLQPQFNANSKDLVSCNVAAKAAVDNAFLWAKHLHTEFSKPLQSRLSYVTVSRIDGGFGYLNSAALSKAELNQAALSGLTKTLSHEWPNVFCRALDIANDIDAKTFANAIIAELFDVNAAAPNAKRLTEVGISPQGRATLVAAKNNTSHYPAVVLTQQDTLLVTGGAKGVTFECALTLAKQCQSHFVLAGRSQHLGKDMPAWAQGKQASELKAAAISYIQSQGEKPTPKQIDALVWPVQSSLEIDRALSAFTEVGASAQYVAMDVSNPDAVKAALAALTDTNGKNRVINGVIHGAGVLADKHIQDKTLDELNRVYSTKVTGVASIINALDPQHIKLVAMFSSAAGFYGNTGQSDYAMSNEILNKTALKLAAQLPQAKVMSFNWGPWDGGMVSSALKKMFVERGVYVIPLQAGANLFAHSLLSSQSVQMLIGSDMQGSATQDTTAKKPNANTLPHAEGSLTFSAPYWAADTQTVTVTRVLQPNELVFVNDHRIAGNPVLPTVCAIQWMRETAQTLCHVPVSIADYKLLKGIIFDTDQAHLLQLQLTQTGAGLNALISSRALNEPDAAMKPQYQATLVVNDALTPTAVAQSSLPATVLQKLAQVPAIHAGNTLYQNGTLFHGPRLQGIKQVLSFDDEQLVCQVKLAQINPNDCPGFAPSAVSGGSQIFAEDLLLQAMLVWARLKYDAASLPSSMGQFITVAPFASGDQGYIQLEVIKHSGRMLVANVSLYHQDGRLSCQMREAKITISKTLNQAFINQHENQHENQHENEHENQPANQHSKDSV

SEQ ID NO: 3 - DNA, 2079 bp, Shewanella oneidensis
  misc_feature: SGI cDNA ID NO. 1258278
  misc_feature: PfaB gene
  misc_feature: Encodes the peptide sequence at SEQ ID NO 4
  misc_feature: Useful for modulating production of PUFA
gtgaccctttcagtcaatgcgatgtccgcagaccaacaagcagcgttaacagctgatctcaaacagcaacaagccaagcctatgcgcttggccttgttgttggctgcacctaataccaaaccagcaaaccatttatccctctcagaactggcggtagactatcaagcgataggcactcagacgttagaagctttgctgatcaacgcggcaagcctgcttggcaatcagcagtgcgatattgtaagtttgggcaataaactgtggattatgcaggcaatcactgcggctaaaaacggcttacatgctcatgcttatttaaacgcaataggctgtggtgacaacagcgaacaagcgattaatcaggcactggttcatgccaaaagacaacatactcaacctcaagtggtagagttaactcaggctaataatgcactcaatgcactcatcgcactgattaacgacattacctgtagacgtatgcccaacagccaagactattggtttacaccagcccaccaaagtcgcgtggccagcttgtgttacccaagtaacattggtgtactcgcactcgtgttcactcagggcagtcaattactgagtgctaaaccattattggccgcaaaccgcttaatgttgccactatctgcacacagtatttcgcaattacacacacgattaacgtccctttgcgacgcattaagtaagccatgcgatgagctaagcctacttaaatttatccaccaacaatggcaacaataccaatcgcaagcgccttatgccttggtattaatggcgacaagtcaaagcggtttacagcaagaagcatcggccatgcttgaggcacttgatactcaacaaactcaaaacgcctcaacgcttaacaacacaagctttcactacaaaacacctgtaggcagttgctttaccgcttcaccattaggtgccaaagggctcagttttgtctacccaggtgtcggcacggtttatccgcagatgtttagccagctcggtcatgtgttccctcacgtttttgctaagttagaggctgagggcaacctccccgcaatgctgcaaactcaagccatttatgccacgcaagaaaaaaccaatagccacatgagcctgagcgagcttgccattgccggtgtgggcgcaagttatatgctcagtaaaatattgcaggatgaatttgccattaccccagcattcgcccttgggtactcaatgggcgaagccgccatgtgggccagtttaggggtatggcatgcaccacaccacttaattaacgccacccaaaacagcagtatttttaatcaagacattgctggcgaactgcgttgtgtcagacaagcctggcaattaaccaatgatcaacccatagtgtggaacagctttgtgacccgcgcctcggttgccgaaatcaggccgcatttagccaattacccacgtgttcatattgccattattcagggcgacagcttagtgttagccggctgcgaagaaagcattaaagccttactaaaacaagccggcaaacgcggtattgccgccaatcgagtcactgcaatgcatacccctgcagcgcttaatattgttgacgatgtaaaacagttttacttacagcctttagccgcagccttgccgacagccactcagtttttatcggccgcccaaacacagcccgttgaattaacatcccatgctattgccaagtcaattgccgacaccttttgccatccactggattttagccagcttatcaagcagtcgattagtcaggggagtcgcttatttgttgaggtcggtgccgacaggcaaaccgccaccttaatcgataaaattattggccaacaaacaagccaggtgccagcgcaggcattagccgttaatgctaaaggcgctgacgacatcagcagtttattaaaatgtttagcccagttaatgacccacagagtgccgatgtcattaaccccgtttattcaaagtctacaagacgtaattaacgacacattattcatcgataccaagcattcacctcttggttttagtgacactttatcagaaggagaacctcattga

SEQ ID NO: 4 - protein, 692 aa, Shewanella oneidensis
  misc_feature: SGI Peptide ID NO. 1258278
  misc_feature: PfaB polypeptide
  misc_feature: PfaB polypeptide
  misc_feature: Useful for modulating production of PUFA
  misc_feature (15)..(692): NCBI GI: 114562398 Blast Desc: omega-3 polyunsaturated fatty acid synthase PfaB [Shewanella frigidimarina NCIMB 400] gi|114333691|gb|ABI71073.1| omega-3 polyunsaturated fatty acid synthase PfaB [Shewanella 400]
  misc_feature (20)..(692): NCBI GI: 91793979 Blast Desc: omega-3 polyunsaturated fatty acid synthase PfaB [Shewanella denitrificans OS217] gi|91715981|gb|ABE55907.1| omega-3 polyunsaturated fatty acid synthase PfaB [Shewanella
  misc_feature (20)..(663): NCBI GI: 336310879 Blast Desc: omega-3 polyunsaturated fatty acid synthase subunit, PfaB [Shewanella sp. HN-41] gi|335865559|gb|EGM70575.1| omega-3 polyunsaturated fatty acid synthase subunit, PfaB [Shewanella sp.
  misc_feature (22)..(692): NCBI GI: 219806606 Blast Desc: omega-3 polyunsaturated fatty acid synthase PfaB [Shewanella livingstonensis]
  misc_feature (25)..(691): NCBI GI: 217974088 Blast Desc: PfaB family protein [Shewanella baltica OS223] gi|217499223|gb|ACK47416.1| PfaB family protein [Shewanella baltica OS223]
  misc_feature (60)..(663): NCBI GI: 304409534 Blast Desc: PfaB family protein [Shewanella baltica OS183] gi|304352052|gb|EFM16450.1| PfaB family protein [Shewanella baltica OS183] gi|333819485|gb|AEG12151.1| PfaB family protein
  misc_feature (60)..(691): NCBI GI: 334862820 Blast Desc: PfaB family protein [Shewanella baltica OS117]
  misc_feature (60)..(691): NCBI GI: 126173662 Blast Desc: PfaB family protein [Shewanella baltica OS155] gi|125996867|gb|ABN60942.1| omega-3 polyunsaturated fatty acid synthase PfaB [Shewanella baltica OS155]
  misc_feature (82)..(691): NCBI GI: 152999950 Blast Desc: PfaB family protein [Shewanella baltica OS185] gi|151364568|gb|ABS07568.1| PfaB family protein [Shewanella baltica OS185]
  misc_feature (83)..(663): NCBI GI: 120599575 Blast Desc: omega-3 polyunsaturated fatty acid synthase PfaB [Shewanella sp. W3-18-1] gi|146292428|ref|YP_001182852.1| omega-3 polyunsaturated fatty acid synthase PfaB [Shewanella putrefaciens
  misc_feature (315)..(617): Pfam Id: PF00698 Pfam Desc: Acyl transferase domain
  misc_feature (472)..(617): Pfam Id: PF00698 Pfam Desc: Acyl transferase domain
MTLSVNAMSADQQAALTADLKQQQAKPMRLALLLAAPNTKPANHLSLSELAVDYQAIGTQTLEALLINAASLLGNQQCDIVSLGNKLWIMQAITAAKNGLHAHAYLNAIGCGDNSEQAINQALVHAKRQHTQPQVVELTQANNALNALIALINDITCRRMPNSQDYWFTPAHQSRVASLCYPSNIGVLALVFTQGSQLLSAKPLLAANRLMLPLSAHSISQLHTRLTSLCDALSKPCDELSLLKFIHQQWQQYQSQAPYALVLMATSQSGLQQEASAMLEALDTQQTQNASTLNNTSFHYKTPVGSCFTASPLGAKGLSFVYPGVGTVYPQMFSQLGHVFPHVFAKLEAEGNLPAMLQTQAIYATQEKTNSHMSLSELAIAGVGASYMLSKILQDEFAITPAFALGYSMGEAAMWASLGVWHAPHHLINATQNSSIFNQDIAGELRCVRQAWQLTNDQPIVWNSFVTRASVAEIRPHLANYPRVHIAIIQGDSLVLAGCEESIKALLKQAGKRGIAANRVTAMHTPAALNIVDDVKQFYLQPLAAALPTATQFLSAAQTQPVELTSHAIAKSIADTFCHPLDFSQLIKQSISQGSRLFVEVGADRQTATLIDKIIGQQTSQVPAQALAVNAKGADDISSLLKCLAQLMTHRVPMSLTPFIQSLQDVINDTLFIDTKHSPLGFSDTLSEGEPH

SEQ ID NO: 5 - DNA, 5790 bp, Shewanella oneidensis
  misc_feature: SGI cDNA ID NO. 1258274
  misc_feature: PfaC gene
  misc_feature: Encodes the peptide sequence at SEQ ID NO 6
  misc_feature: Useful for modulating production of PUFA
ttgagttctcaagctactcccaaaattgccattgtaggcttagccaatcaataccctgatgccgatactccagcaaggttttggcaaaatttaattgataaaaaagactctcgtagccaaattagtgcgcacaaactcaatgcatccccaagcgactatattggtgttcaagggcagtctgaccgtttttattgtgataaaggcggctatattcaaaattttagctttaatcccaatggttaccgtatcaacagcggtgcctttgaaggcctagacgacagctttttatgggctaccgataccgcacgtaatgccttagccgatgccgggattaacgaccttaaccacccctgtttgcagcgcaccggcattgtcatgggcaccttgtcgttcccaacggcaaagtcaaaccaattgtttgtgccgctgtaccacagcgtggtcgaaaaagccttacaaaccaaattacagcaacctcattttgtgctgcaagattttggcttgtcgccccaaacagagcaatacaattggcgcaatggcgcagtggctcacaatgcctctaagctcgtggctgatgccctagggcttggcggcgcgcaattaagcctagacgctgcctgcgcaagttcagtttacgcattaaaactcgcctgtgattatttgcacacgggcaaagccgacatcatgctggctggcgcagtttcgggcgcagatcccttttttatcaatatgggattttcaatttttcatgcctatccagaccatggcatttctgcaccgtttgacagcaacagtaaaggcttgtttgccggtgaaggcgctggtgtattagtgcttaagcgccttgaagatgcccagcgcgatggcgaccatatctatgccctcgtaagcggcattggtttatcaaacgacggtaagggccagtttgtgctcagccccaacagcaaaggccaagtacaagcctttgagcgagcctaccgcgaagctgcggcatttgactcaagcattaccccagccagcattgaagtgattgaatgccatgccacaggaacaccattaggcgacaaagttgaattaacctcaatggagcgtttttttgaaggcaaactcaatggcagtgccacaccgttaattggctcggctaaatcaaacctcgggcatttgcttactgctgcgggcatgcctggtatcatgaaaatgatttttgccatgcgtgaaggtgtactaccaccgagtattaatatcagcgcacctatcgcctcacctaatggtttatttggtcaggcaaccttgccaagcgaggtgcaaccttggccagataaagcaggtaacaactcacgccatgcgggtgtatcagtatttggctttggtggctgtaacgcgcatttgctattagagtcctactctgacacagcggtcacatcgtcaacgccaacgcaattagttaacgccagtgagcaacccatgcacattaccggcatggcagctcattttggccaatgcagtagcattaatcagctggctgagcgtattcgcgccaagcaacacttgtttacaccattgcccactcaacgctggaaaggcattaacaagcatccagaactgttgaccaaatatggtttagagcaagtgccacaaggggcttacattgatcaattcgattttgactttttacgctttaaagtgccgcctaatgaagacgatcgattaatttcgcagcagctgttattaataaaagtggccgacgaagccattgtaaacgccaaacttaatccaggcagtaaagtggccgtgttagtggccatggaaaccgaacttgagctacatcaatttcgtggccgagtgaacttacacagccagcttgcgcaaagcttaaccgcccagggtattgagctcagtgacgatgaataccaagcgctagaagccatcgccatggacagcgtgctcgatgcggccaaactaaaccaatacaccagttttattggtaatattatggcgtcgcggatttcgtcattgtgggactttaacggccccgcctttacgatttcggccgctgaacaatcggttaatcgctgtattgatgtggcgcaaaacttatttgccatgggctcactgcaagagcctctcgatgcagtcattattgctgcggttgatttgtctggcagtattgaaaacggtttgcttaacagtgctaaccttaagttagcaggcttacaaaccaataacgttcaaattggtgaaggtgctggcgccattgtattacagcaaacgcacctaaatgacagctacgccagtattaatagcgtgcagtttgctaagcaagaacaggtcacactaaagcaaacctgcgatatcaatgaactcaatatcgctccgctttgccaacagtcagatttggggcagcagttaactcgccaattggctcaacttgctgacgccagcagcatatcaagcgtgcaacctttgcttgggcacacgtttgccgcctctggcatggcaagtttgctcaatgcactgatccaaagccagcaactacaacaagctgacatcagtgcgcaggtgatcagcgccagtgaaaaccaatactctcgcattggtttatcgcttaataccttacagcaacaggcccttgccaaccgcttaacccagacgcttacagagcaactgacaaaaagcgccaagctgagtttaattaaacaagtgagtttaggtggccgcgatatctatcaacatattgtcgacacgccagttgccgccatcgacaaaatgattagccaatgcgcgtcgattaagcgcgaaaccgtgcaacaagccccaacaaacatgaatataaacgagccgactatgcccgcaagccattttgcaccaatccctggcacgccggggcaaacaccaaacaacactcattcgactcaagcaattagccaggccattccacctgcacacttaacggcttttgagcaaaaccaatggctggcacaacaagcccacctcgcgtttttagcctgccgtgaggcaggcttaaaagtcgccgataacttgttaaaatcacaactcgcctcaataacgtcagctgcaacagcgcaaacaatagcacccgcgttaactgccaaagtgccagctgagcattacgttaaaccacaatcggtactggcagaacgtaaacctaaccatgcgcaggttccgacttatacagcccccactccggcagataaaccctgtatttggaactatgccgatttagtggaatatgccgaaggcgatatcgccaaggtgtttggcccagactacgccattatcgacagctactcgcggcgcgtgcgcttacccaccaccgactatttactggtgtcgcgagtcaccaaacttgatgcaaccataaatcaatacaaaccttgctcaatgactacagagtacgacatcccggttgatgcaccgtatctggttgatggtcaaatcccttgggcagttgcagttgagtcgggccagtgcgatttaatgttaattagctatttaggcatcgattttgaaaacaaaggcgagcgggtttatcgtttgcttgattgcacgcttaccttcttaggcgatttaccacgcggcggcgacacattacgctatgacattaaaatcaacaactttgcccgcaatggcgacaccttattgtttttcttctcgtacgaatgctttgtcggcgacaagatgattttaaaaatggatggcggttgtgcgggcttctttaccgacaaagaattagccgatggtaaaggggttatccaaacagaagatgaaattaagctgcgtcagcaagtgcttaacaacccaaataaaccgacgtttactcctttgctacactgtcagcaaacagcgtttgattatggccaaattcatcatttattaaccggcgatattggcagctgctttggcggcgcacatgtgagccaccagctgcaaacgggcatgcaaaaatcactgtgttttgcctcagaaaagttcttaatgatcgagcgcgtaagcaacttacaaacccatggcggcacctggggcctggggttagttgaaggccacaaacaattagcgccagaccattggtacttcccgtgtcattttaaagacgatcaggtgatggccggctcattaatggctgaaggctgtggccaattattgcagttctttatgttgcacattggtatgcataccttagttgaaaacggccgtttccagccgctcgaaaatgcctcacaaaaagtacgttgccgtggccaggtattaccacaacatggtgaattaacttaccgaatggaagtcaccgaaatcggtacttcgccgcgcccatacgccaaagccaatattgatattttgctcaatggcaaagtggtggtcgacttccaaaaccttggggtgatgataaaagaagaagcccaatgcactcgctatttaagtcatacgagcacgaatgccaacacaggcaccagtatcaagccaactaaagtggctgacaccaacgtcaataacgctgccagccagcaagatgccgccccgttaatggcgaaaattgccgacaccagcgcgccaaccaacaaaggggttattccgcttaaacacgttgaagcgccgcaagtcagtgctgattctaaatacgcaaaccgcgtgcctgataccctgccatttacgccgtatcacatgtttgagtttgccactggcgatatcgaaaaatgctttggaccagactttagcatctataaaggcttaatcccgccgcgcaccccatgcggtgatttacagctgaccacccgcgttatcgacattaacggtaagcgcggcgagctgaaaaaaccgtcatcctgtgtggctgaatacgaagtgcccgcaaatgcatggtattttgctaaaaacagccacccagcggtgatgccttattcggtgttaatggaaatatcactgcaacctaatggttttatttcaggctatatgggcactacactaggcttccctgggcaggagttgtttttccgtaacctagatggtcacggcaccttgttacgccatgtggatttacgcggcaaaaccattgttaatgactcacgcttattatctaccgtgattgcaggcagcaatattattcaaaactttacctttgatttaagtgtcgatggcgagccgttttacactggcggcgctgtatttggctactttaaagctgacgcgcttaaaaaccagcttggcatcgataacggtaaaatcactcagccctggcatgtcgacaataatgttgctgccgacaccattgtcaatttactcgataagcaatcgcggctgtttaatgcgccagcgcaccagccacattaccgcttagccggtggccaacttaactttatcgacaccgctgaaatcgtcaataacggcggcaagtataagcagggctatttagctgcatcacgcaccattgacccaagtgattggtttttccaattccatttccatcaagatccggtaatgccagggtcattaggcgttgaagctatcatcgagttaatgcaaacttacgcgattactaacgacttgggagcgggttttgccaatcctaaattcggccagattttgtctgatataaaatggaaataccgtggccaaattaacccactgaacaaacaaatgtcgttagatgtgcacatcagtgccgtaaaagacgaaaacggcaaacgcatcattattggcgacgccaatttaagtaaagatggtttacgcatttacgaagtaaaagacatcgctatttgtattgaagaagcctag

SEQ ID NO: 6 - protein, 1929 aa, Shewanella oneidensis
  misc_feature: SGI Peptide ID NO. 1258274
  misc_feature: PfaC polypeptide
  misc_feature: PfaC polypeptide
  misc_feature: PfaC polypeptide
  misc_feature: Useful for modulating production of PUFA
  misc_feature (1)..(1929): NCBI GI: 114562397 Blast Desc: Beta-hydroxyacyl-(acyl-carrier-protein) dehydratase, FabA/FabZ [Shewanella frigidimarina NCIMB 400] gi|114333690|gb|ABI71072.1| dehydratase, FabA/FabZ [Shewanella
  misc_feature (1)..(1929): NCBI GI: 91793980 Blast Desc: Beta-hydroxyacyl-(acyl-carrier-protein) dehydratase, FabA/FabZ [Shewanella denitrificans OS217] gi|91715982|gb|ABE55908.1| dehydratase, FabA/FabZ [Shewanella
  misc_feature (1)..(1929): NCBI GI: 336310878 Blast Desc: omega-3 polyunsaturated fatty acid synthase subunit, PfaC [Shewanella sp. HN-41] gi|335865558|gb|EGM70574.1| omega-3 polyunsaturated fatty acid synthase subunit, PfaC [Shewanella sp.
  misc_feature (1)..(1929): NCBI GI: 126173661 Blast Desc: Beta-hydroxyacyl-(acyl-carrier-protein) dehydratase FabA/FabZ [Shewanella baltica OS155] gi|125996866|gb|ABN60941.1| Beta-hydroxyacyl-(acyl-carrier-protein) dehydratase, FabA/FabZ
  misc_feature (2)..(1929): NCBI GI: 120599576 Blast Desc: Beta-hydroxyacyl-(acyl-carrier-protein) dehydratase, FabA/FabZ [Shewanella sp. W3-18-1] gi|146292427|ref|YP_001182851.1| dehydratase, FabA/FabZ CN-32]
  misc_feature (2)..(1929): NCBI GI: 152999949 Blast Desc: beta-hydroxyacyl-(acyl-carrier-protein) dehydratase FabA/FabZ [Shewanella baltica OS185] gi|151364567|gb|ABS07567.1| Beta-hydroxyacyl-(acyl-carrier-protein) dehydratase FabA/FabZ
  misc_feature (2)..(1929): NCBI GI: 160874569 Blast Desc: beta-hydroxyacyl-(acyl-carrier-protein) dehydratase FabA/FabZ [Shewanella baltica OS195] gi|160860091|gb|ABX48625.1| Beta-hydroxyacyl-(acyl-carrier-protein) dehydratase FabA/FabZ
  misc_feature (2)..(1929): NCBI GI: 206570566 Blast Desc: PfaC [Shewanella sp. BR-2]
  misc_feature (8)..(285): Pfam Id: PF00109 Pfam Desc: Beta-ketoacyl synthase, N-terminal domain
  misc_feature (12)..(1929): NCBI GI: 319425728 Blast Desc: multi-domain beta-ketoacyl synthase, PfaC [Shewanella putrefaciens 200]
  misc_feature (126)..(1929): NCBI GI: 219806608 Blast Desc: Beta-hydroxyacyl-(acyl-carrier-protein) dehydratase, FabA/FabZ [Shewanella livingstonensis]
  misc_feature (293)..(415): Pfam Id: PF02801 Pfam Desc: Beta-ketoacyl synthase, C-terminal domain
  misc_feature (488)..(704): Pfam Id: PF00109 Pfam Desc: Beta-ketoacyl synthase, N-terminal domain
  misc_feature (1328)..(1462): Pfam Id: PF07977 Pfam Desc: FabA-like domain
  misc_feature (1787)..(1920): Pfam Id: PF07977 Pfam Desc: FabA-like domain
MSSQATPKIAIVGLANQYPDADTPARFWQNLIDKKDSRSQISAHKLNASPSDYIGVQGQSDRFYCDKGGYIQNFSFNPNGYRINSGAFEGLDDSFLWATDTARNALADAGINDLNHPCLQRTGIVMGTLSFPTAKSNQLFVPLYHSVVEKALQTKLQQPHFVLQDFGLSPQTEQYNWRNGAVAHNASKLVADALGLGGAQLSLDAACASSVYALKLACDYLHTGKADIMLAGAVSGADPFFINMGFSIFHAYPDHGISAPFDSNSKGLFAGEGAGVLVLKRLEDAQRDGDHIYALVSGIGLSNDGKGQFVLSPNSKGQVQAFERAYREAAAFDSSITPASIEVIECHATGTPLGDKVELTSMERFFEGKLNGSATPLIGSAKSNLGHLLTAAGMPGIMKMIFAMREGVLPPSINISAPIASPNGLFGQATLPSEVQPWPDKAGNNSRHAGVSVFGFGGCNAHLLLESYSDTAVTSSTPTQLVNASEQPMHITGMAAHFGQCSSINQLAERIRAKQHLFTPLPTQRWKGINKHPELLTKYGLEQVPQGAYIDQFDFDFLRFKVPPNEDDRLISQQLLLIKVADEAIVNAKLNPGSKVAVLVAMETELELHQFRGRVNLHSQLAQSLTAQGIELSDDEYQALEAIAMDSVLDAAKLNQYTSFIGNIMASRISSLWDFNGPAFTISAAEQSVNRCIDVAQNLFAMGSLQEPLDAVIIAAVDLSGSIENGLLNSANLKLAGLQTNNVQIGEGAGAIVLQQTHLNDSYASINSVQFAKQEQVTLKQTCDINELNIAPLCQQSDLGQQLTRQLAQLADASSISSVQPLLGHTFAASGMASLLNALIQSQQLQQADISAQVISASENQYSRIGLSLNTLQQQALANRLTQTLTEQLTKSAKLSLIKQVSLGGRDIYQHIVDTPVAAIDKMISQCASIKRETVQQAPTNMNINEPTMPASHFAPIPGTPGQTPNNTHSTQAISQAIPPAHLTAFEQNQWLAQQAHLAFLACREAGLKVADNLLKSQLASITSAATAQTIAPALTAKVPAEHYVKPQSVLAERKPNHAQVPTYTAPTPADKPCIWNYADLVEYAEGDIAKVFGPDYAIIDSYSRRVRLPTTDYLLVSRVTKLDATINQYKPCSMTTEYDIPVDAPYLVDGQIPWAVAVESGQCDLMLISYLGIDFENKGERVYRLLDCTLTFLGDLPRGGDTLRYDIKINNFARNGDTLLFFFSYECFVGDKMILKMDGGCAGFFTDKELADGKGVIQTEDEIKLRQQVLNNPNKPTFTPLLHCQQTAFDYGQIHHLLTGDIGSCFGGAHVSHQLQTGMQKSLCFASEKFLMIERVSNLQTHGGTWGLGLVEGHKQLAPDHWYFPCHFKDDQVMAGSLMAEGCGQLLQFFMLHIGMHTLVENGRFQPLENASQKVRCRGQVLPQHGELTYRMEVTEIGTSPRPYAKANIDILLNGKVVVDFQNLGVMIKEEAQCTRYLSHTSTNANTGTSIKPTKVADTNVNNAASQQDAAPLMAKIADTSAPTNKGVIPLKHVEAPQVSADSKYANRVPDTLPFTPYHMFEFATGDIEKCFGPDFSIYKGLIPPRTPCGDLQLTTRVIDINGKRGELKKPSSCVAEYEVPANAWYFAKNSHPAVMPYSVLMEISLQPNGFISGYMGTTLGFPGQELFFRNLDGHGTLLRHVDLRGKTIVNDSRLLSTVIAGSNIIQNFTFDLSVDGEPFYTGGAVFGYFKADALKNQLGIDNGKITQPWHVDNNVAADTIVNLLDKQSRLFNAPAHQPHYRLAGGQLNFIDTAEIVNNGGKYKQGYLAASRTIDPSDWFFQFHFHQDPVMPGSLGVEAIIELMQTYAITNDLGAGFANPKFGQILSDIKWKYRGQINPLNKQMSLDVHISAVKDENGKRIIIGDANLSKDGLRIYEVKDIAICIEEA

SEQ ID NO: 7 - DNA, 1629 bp, Shewanella oneidensis
  misc_feature: SGI cDNA ID NO. 1258275
  misc_feature: PfaD gene
  misc_feature: Encodes the peptide sequence at SEQ ID NO 8
  misc_feature: Useful for modulating production of PUFA
atgacaacccaattaaaaaacgaaaagctttctccatggccttggcaagtgagccagcagcacgttagttttgatccagcagggatcaacaaaaagcttaaagacttgtcgcaagcctgttatgtggtcaatgatgctcagcaaggtttaggcgttgcacagcaagctcaagtggtgacagataccatcaccaatgctcatgccctgcccgttagcgcctttgccccagctcttggcacccaaagtttaggtgacagtaattttcgccgtgtgcatggggtaaaatatgcctattatgctggagccatggccaatggtattgcctctgaagagctagttatcgcattaggtcaggcgggtattttatgctcgtttggcgccgcgggacttattccctcgcgcgttgagcaagccattaagcgcattcaagctgccctgccaaatgggccctatgcgtttaacttaatccatagcccaagtgaacccgcgctcgagcgtggtagcgttgagctatttttaaaacacaaagtacgcaccgttgaagcctcagcctttttgggcttaacaccgcaaattgtctattaccgagcagcagggttaagccgtgatgctcaaggtgatattcaaatagacaacaaagttatcgccaaaattagccgcaccgaagtggcaattaagtttatgcagccagccccggtaaaaatactgcaacaactggtggatgaaggtcttattacgccagagcaaatggcgctagcacaattagtgccgatggcggatgatattaccgctgaagccgattctggtggtcataccgataaccgcccattagtgaccttattacccactattttggcgcttaaagatgaagtacaagccaagtacaattacaaaacacccatccgcgtaggcgccggtggtggtgtcggtacgcccgatgctgccctagcaacctttaacatgggcgcagcatttattgtcacaggttcaattaaccaggcttgtgttgaagcgggggccagtgagcatacgcgtaaattattggccaccacagaaatggccgatgtcaccatggcgccagcagccgatatgttcgaaatgggtgtaaaactgcaagtggtcaaacgcggcaccttgttcccgatgcgcgctaacaagttatacgaaatttacactcgttatgactcaatagaagccatcccgagcgatgagcgtgaaaaacttgaaaaacaagtgtttcgctcaagcttagatgatatttgggccggtacagtggcgcattttaatgagcgagaccctaagcaaatcgagcgcgctaaagataaccctaagcgcaaaatggcattaattttccgctggtaccttgggctatcaagccgttggtcaaacactggggaaacaggccgtgaaatggattatcaaatctgggccggacctgcactaggtgcatttaacgcctgggcaaaaggcagttacttagacgattatactcaacgacatgctgtcgatttagcaaaacacttaatgcatggcgcagcttacttagcacgagtcaatctacttgccgcacaaggtgtgagcctacccgttgcattacaacgttggcgccccgcggatcaggtgaaatag

SEQ ID NO: 8 - protein, 542 aa, Shewanella oneidensis
  misc_feature: SGI Peptide ID NO. 1258275
  misc_feature: PfaD polypeptide
  misc_feature: PfaD polypeptide
  misc_feature: Useful for modulating production of PUFA
  misc_feature (1)..(542): NCBI GI: 219806610 Blast Desc: omega-3 polyunsaturated fatty acid synthase PfaD [Shewanella livingstonensis]
  misc_feature (1)..(542): NCBI GI: 114562396 Blast Desc: 2-nitropropane dioxygenase, NPD [Shewanella frigidimarina NCIMB 400] gi|114333689|gb|ABI71071.1| 2-nitropropane dioxygenase, NPD [Shewanella frigidimarina NCIMB
  misc_feature (1)..(541): NCBI GI: 91793981 Blast Desc: Sden_2630 [Shewanella denitrificans OS217] gi|91715983|gb|ABE55909.1| conserved [Shewanella denitrificans OS217]
  misc_feature (2)..(537): NCBI GI: 114048228 Blast Desc: 2-nitropropane dioxygenase, NPD [Shewanella sp. MR-7] gi|113889670|gb|ABI43721.1| 2-nitropropane dioxygenase, NPD [Shewanella sp. MR-7]
  misc_feature (2)..(537): NCBI GI: 117921284 Blast Desc: 2-nitropropane dioxygenase, NPD [Shewanella sp. ANA-3] gi|117613616|gb|ABK49070.1| 2-nitropropane dioxygenase, NPD [Shewanella sp. ANA-3]
  misc_feature (6)..(540): NCBI GI: 304409532 Blast Desc: PfaD family protein [Shewanella baltica OS183] gi|304352050|gb|EFM16448.1| PfaD family protein [Shewanella baltica OS183] gi|333819487|gb|AEG12153.1| PfaD family protein
  misc_feature (6)..(540): NCBI GI: 120599577 Blast Desc: 2-nitropropane dioxygenase, NPD [Shewanella sp. W3-18-1] gi|146292426|ref|YP_001182850.1| 2-nitropropane dioxygenase, NPD [Shewanella putrefaciens CN-32] 2-nitropropane
  misc_feature (6)..(540): NCBI GI: 126173660 Blast Desc: PfaD family protein [Shewanella baltica OS155] gi|125996865|gb|ABN60940.1| 2-nitropropane dioxygenase, NPD [Shewanella baltica OS155] gi|334862818|gb|AEH13289.1| PfaD
  misc_feature (6)..(537): NCBI GI: 336310877 Blast Desc: enoyl-[acyl-carrier-protein] reductase [FMN] , inferred for PFA pathway [Shewanella sp. HN-41] gi|335865557|gb|EGM70573.1| enoyl-[acyl-carrier-protein] [FMN] ,
  misc_feature (6)..(540): NCBI GI: 152999948 Blast Desc: PfaD family protein [Shewanella baltica OS185] gi|160874568|ref|YP_001553884.1| PfaD family protein [Shewanella baltica OS195] gi|151364566|gb|ABS07566.1| PfaD family protein
  misc_feature (80)..(518): PfaD family protein
  misc_feature (88)..(363): Pfam Id: PF03060 Pfam Desc: Nitronate monooxygenase / enoyl reductase
MTTQLKNEKLSPWPWQVSQQHVSFDPAGINKKLKDLSQACYVVNDAQQGLGVAQQAQVVTDTITNAHALPVSAFAPALGTQSLGDSNFRRVHGVKYAYYAGAMANGIASEELVIALGQAGILCSFGAAGLIPSRVEQAIKRIQAALPNGPYAFNLIHSPSEPALERGSVELFLKHKVRTVEASAFLGLTPQIVYYRAAGLSRDAQGDIQIDNKVIAKISRTEVAIKFMQPAPVKILQQLVDEGLITPEQMALAQLVPMADDITAEADSGGHTDNRPLVTLLPTILALKDEVQAKYNYKTPIRVGAGGGVGTPDAALATFNMGAAFIVTGSINQACVEAGASEHTRKLLATTEMADVTMAPAADMFEMGVKLQVVKRGTLFPMRANKLYEIYTRYDSIEAIPSDEREKLEKQVFRSSLDDIWAGTVAHFNERDPKQIERAKDNPKRKMALIFRWYLGLSSRWSNTGETGREMDYQIWAGPALGAFNAWAKGSYLDDYTQRHAVDLAKHLMHGAAYLARVNLLAAQGVSLPVALQRWRPADQVK

SEQ ID NO: 9 - DNA, 918 bp, Shewanella oneidensis
  misc_feature: SGI cDNA ID NO. 1264359
  misc_feature: PfaE gene
  misc_feature: Encodes the peptide sequence at SEQ ID NO 10
  misc_feature: Useful for modulating production of PUFA
atgcccattcatgccgctgtaaattcattgtatccctttacaaaaagctacatctactttgtttcactcaatgcacaactgtcagcagcagactttgataagggattagctctagcctggttaagccctgatgaagcggcaaaagttgctcgttataagagtccatctgcgcgtaataatgctctacaagttcgcttagccttaagggctatattgtcgcgccacagtgccgttaatcctgcgcaatggcaatttacttatggtgaaaagggtaagccggcattaagccaagaatggtttgccaaaacgggcctgtattttaacttaagtcatagcggccaatggttaatgattggtgtgataacaggcactaaatgtaaccttagtaccgattttcaaggccttgatgagttatttgttggagttgatattgagcgtgaacgcagcagtaccgatattgtgccaatattacatcactattttactcaggcagaaaccgatgcattattgcagttgccaattgagttacaacgacaacgtttctttgatttatgggcggtaaaagagtcttacattaaggcgcgaggcttggggcttgccttgtcgttgaagtcattttcagttgattttagtgcgacggtgctcagcaatgccactctaaaactgccagacaatagcagtaaaatgatacctatgtttgagccggttaaattgtcttttagcgacgcgaatgaccccgctgcaaccgatgtgacttggcaaacgttaatggggcgtttgaatgagggataccgtttttctatgacattaggaataccccgtagagtttacaatagcattgatttgcagtctggctcgatatccaacaccttgacgtgcgttcaattagaactcggtgacttattaaacaacaaataa

SEQ ID NO: 10 - protein, 305 aa, Shewanella oneidensis
  misc_feature: SGI Peptide ID NO. 1264359
  misc_feature: PfaE polypeptide
  misc_feature: Useful for modulating production of PUFA
  misc_feature (7)..(269): NCBI GI: 170727642 Blast Desc: 4'-phosphopantetheinyl transferase [Shewanella woodyi ATCC 51908] gi|169812989|gb|ACA87573.1| 4'-phosphopantetheinyl transferase [Shewanella woodyi ATCC 51908]
  misc_feature (13)..(303): NCBI GI: 18542421 Blast Desc: AF467805_1 phosphopantetheinyl transferase [Shewanella sp. SC2A]
  misc_feature (13)..(303): NCBI GI: 149675712 Blast Desc: 4'-phosphopantetheinyl transferase [Shewanella livingstonensis]
  misc_feature (13)..(303): NCBI GI: 114562423 Blast Desc: 4'-phosphopantetheinyl transferase [Shewanella frigidimarina NCIMB 400] gi|114333716|gb|ABI71098.1| 4'-phosphopantetheinyl transferase [Shewanella frigidimarina 400]
  misc_feature (18)..(271): NCBI GI: 206570562 Blast Desc: 4'-phosphopantetheinyl transferase [Shewanella sp. BR-2]
  misc_feature (18)..(271): NCBI GI: 126173665 Blast Desc: 4'-phosphopantetheinyl transferase [Shewanella baltica OS155] gi|125996870|gb|ABN60945.1| 4'-phosphopantetheinyl transferase [Shewanella baltica OS155] 4'-phosphopantetheinyl
  misc_feature (18)..(271): NCBI GI: 160874573 Blast Desc: 4'-phosphopantetheinyl transferase [Shewanella baltica OS195] gi|160860095|gb|ABX48629.1| 4'-phosphopantetheinyl transferase [Shewanella baltica OS195] 4'-phosphopantetheinyl
  misc_feature (36)..(303): NCBI GI: 93209541 Blast Desc: polyunsaturated fatty acid synthase [Pseudoalteromonas sp. DS-12]
  misc_feature (40)..(276): NCBI GI: 163751060 Blast Desc: 4'-phosphopantetheinyl transferase family protein [Shewanella benthica KT99] gi|161329221|gb|EDQ00220.1| 4'-phosphopantetheinyl transferase family protein [Shewanella
  misc_feature (40)..(271): NCBI GI: 294139977 Blast Desc: 4'-phosphopantetheinyl transferase family protein [Shewanella violacea DSS12] gi|293326446|dbj|BAJ01177.1| 4'-phosphopantetheinyl transferase family protein [Shewanella
  misc_feature (60)..(211): Pfam Id: PF01648 Pfam Desc: 4'-phosphopantetheinyl transferase superfamily
  misc_feature (140)..(203): Pfam Id: PF01648 Pfam Desc: 4'-phosphopantetheinyl transferase superfamily
MPIHAAVNSLYPFTKSYIYFVSLNAQLSAADFDKGLALAWLSPDEAAKVARYKSPSARNNALQVRLALRAILSRHSAVNPAQWQFTYGEKGKPALSQEWFAKTGLYFNLSHSGQWLMIGVITGTKCNLSTDFQGLDELFVGVDIERERSSTDIVPILHHYFTQAETDALLQLPIELQRQRFFDLWAVKESYIKARGLGLALSLKSFSVDFSATVLSNATLKLPDNSSKMIPMFEPVKLSFSDANDPAATDVTWQTLMGRLNEGYRFSMTLGIPRRVYNSIDLQSGSISNTLTCVQLELGDLLNNK

SEQ ID NO: 11 - DNA, 8199 bp, Artificial Sequence
  synthetic codon optimized gene based on Shewanella oneidensis pfaA gene sequence
  misc_feature: SGI cDNA ID NO. 1261955F-co886
  misc_feature: codon-optimized DNA sequence for expression in chytrid
  misc_feature: Encodes the peptide sequence at SEQ ID NO 2
  misc_feature: Useful for modulating production of PUFA
atgagccagtcttctcaccaggataagcgccttaacaagcgccttaaggatatgcctgtggctattgttggcatggctagcatcttcgctaactctcgctacctcaacaagttttgggacctcatcagcgagaagatcgacgctattgtggacatccctgactctcactggaacgctgacgattactacgacgctgacaagtctgctccagataagtcttactgcaagcgtggcggctttcttcctgaagttgactttaaccctatggagttcggccttcctcctaacatcctcgagctcactgatacttctcagcttctctctcttgttgtggccaaagaggttcttgctgatgctggcgtggatgcccaatacgatactgaccgcatcggcattacacttggtgttggtggtggacaaaagatcaaccactctctctcttctcgccttcaataccctgtgcttaagaaggtgttcaagaactccggcatctctgacgcagattccgaaatgctcatcaagaagttccaggaccagtacatccattgggaggagaacagcttccctggctcacttggcaacgtcattgcaggtcgcattgctaaccgctttgatcttggaggcatgaactgcgttgttgatgctgcttgtgctggttctcttgctgctatgcgtatggctattacagagctcgttgaaggtcgttctgacatgatgattacaggcggtgtttgcacagataacagcccttccatgtacatgagcttctcgaagacccccgctttcaccaccaacgacaccatccagcctttcgacattgactctaagggcatgatgattggagagggcattggcatgatcgcaatcaagcgccttgatgatgctgaacgtgatggcgacaagatttacgcagttattaagggcattggctcttcttctgacggcaagtttaagagcatttacgcacctcgccctgagggccaggctaaggctcttaagcgcgcttacgatgatgcaggttttgcaccacatactgttggccttattgaagctcacggtactggcactgctgctggtgatgttgctgagtttaacggtcttaagagcgtttttgctgaggacaatgatgctcaacagcacattgcacttggttctgttaagtcacaggtgggccacaccaagtctacagctggcaccgcaggcgtgatcaaggttgctcttgctcttcatcacaaggttcttcctcctaccattaacgtgagcaagcctcaccctaagctctctattagcgactctcctttctaccttaacacagaaactcgtccttggcttcctcgtcctgatgatactcctcgtagagcaggcatctcttcttttggctttggtggcaccaacttccacatcgtgctcgaggagtaccgccaagatcatgcacgtaacgacaaataccgtcaacgcacagttcctcagtctctccttattagcgccgacaacaaagcagaacttcaaggtaagcttacccagcttcttaccgagatcaacgcaatcgacatcagccaggcaaacgctcaagaacttgctctccagaagcttggtcaacgcttcgctatctcccaggttgctcctacctcagcacaacttggtcttgtggttgcctctattgcagaccttactgtccagctcactcaagctcttaaccaacttaccaacaacgacgcagataactggcaacttccttcaggtgcttcttaccgctctgcttctcttggtgacaacaacactcctcctaaggttgctgccctctttgcaggtcaaggcgctcagtacgtgaatatggctaccgaactcgcttgcttttaccctgaaatgcgtcagcagcttatgcaggctgataaggtttttgctcagcacaagcaaacccctctttcccagattatgtaccctatccccgctttcgaagctcaagacattgctgctcaacaagctgctctcaccaacaccgcttacgcccaatctgctattggcgctgtctctatgggccaatacgctctttttactcaagctggcttttctcccgacatggttgcaggtcattcttttggcgagctttctgcactttgcgctgctggagttatttctcaggctgactactaccaactcgcttttgctcgtggacaagctatggctgctactcctgctgatcaagatcctggagcaatgtacgccatcatcgtgcctcctcaagcaactgaacaaggcgttaatcaacttgagtcttgcatctctgcttttgacggcgttaaggtcgctaactacaacgcccctacccaacttgtgattgctggtcctactgaagcttgcgctgaagctgctaaggctgttactgctgaacttggctttaaggctatcgctctccctgtttctggcgctttccatacccctcttgttggccatgctcaacaaccttttgctaaggctatctctaaggtgaagttcgctaagcctaaggttaccctctttgctaacggcactggtaagctctacccttctaacggcaaggccattcagaccgccttttctgaacacatgcttcagtctgttcgcttctctgagcagctcgtcgccatgtacgatgctggtgctcgcgtttttgttgagtttggtcctaagaacatccttcagaagcttgttgaggctactcttggtaacaagcctgagaccgtttctgttgtgtccctcaaccctaaccctaagggctcttctgacacccaacttcgtcaagctgctattcaacttgctgttctcggcctccctctctctgaggttgacccttaccaggcccctattgctgaacttaccaacgtttctcctatgaacgttaagcttaccgctcaaaactacatctctcctgctacccagtctaagatgcagaagtctctccaacagggccaggttacctctaagaccgtcgaagttcctgtggagaagattgttgagaagatcgtcgagaagcaggtgatcaagaccgagtacgtcgaggtgccttctacccctgctgcttctgctcaagctcctgttgcacaagctactactgcacaacctgctcatgcttcacaaacatctgcacaagctaataatgccgtgtctaacgatagcctcagcgcattttttgctgcccaacaacaagctgctatgcttcaccagcagttccttgcaattcctcagcagtacggcgacaccttcaactccctcatgaccgctcaagcccaaatggcctcttctggtgtggctattcctgagtctcttcaacgttctatggagctctttcatcaacaccaagcacaaactctccagtctcatactcagttccttacccttcaggctcaaacttctcaggcagctcttgctatgcttcaaggccaagcctctgctactcctgctcctactctcaccaacacccttgctgctcaacagatggtcgctgcacctcaaactcctgttatgactcaagctgctcctgcacctgttactccagaatctattgctcaagttgctcaacctactgctgttaattccgcttctactggtctttctgctgagactgttcaactcaccatgatgaccgttgtcgccgacaagaccggctaccctactgagatgctcgagctctctatggacatggaggctgatcttggcattgactccattaagcgcgtggagatccttggtactgttcaagacgaacttcctggtcttcctgaactttctcctgaagatcttgctgaatgtcgcacacttggagagattgttgattacatgcagagcaccctttccgccagcaccgcttctgctgctgttcaggcacctacaatgcagactactcctgcccaaacctctgttcctacttctggcctttctgctcaaaccgttcttaacaccatgatgaccgttgttgctgataagactggttatcctgctgagatgctcgagcttaccatggatatggaagctgatcttggcattgactccatcaagcgcgtggagatccttggcaccgtgcaagacgagcttcctggtcttcctgagctttctcctgaggatcttgctgaatgccgtactcttggtgagattgttgattacatgcagagcaccctttctgcttctactgcttctggtgcttctacctcttctgctgctcaaactactcaatctactcctgctcaaactgctgctcctacttctggcctctctgcacaaaccgtcctcaacaccatgatgaccgttgttgccgacaagaccggttaccctgctgaaatgctcgaacttaccatggatatggaggctgatcttggcattgactctattaagcgcgtcgagattcttggcaccgttcaagacgaacttcctggacttcctgaactttctcctgaagatctcgctgaatgccgcactcttggcgaaatcgttgactacatgcagagcaccctttctgcctctgctgcttctgcttctcctgttaacgctgcagttcaagcaagcaacaagacttctgctcctacttctgttcctacttctggcctctctgctcaaaccgttcaactcaccatgatgaccgttgttgctgataagaccggttaccctaccgagatgctcgagctttctatggatatggaggctgacctcggcattgactccattaagcgtgtcgagattcttggcaccgttcaggacgaacttcctggtcttcctgagcttaatcctgaagatcttgctgaatgccgcacacttggcgaaattgttgactacatgcagtctaccctttctgcttctaccgctagcgcatctcctgtgaatgctgctgttcaagcctctaacaagacctctgcccctacatctgttcctacttctggcctctctgctcaaactgtgcagcttaccatgatgaccgttgttgctgataagactggttaccctaccgaaatgctcgagctctctatggatatggaggctgatcttggcatcgactctatcaagcgcgtggagattcttggtaccgttcaggacgaacttcctggtcttccagagcttaaccctgaggatcttgctgaatgccgcactcttggcgagattgttgactacatgcaaagcaccctttctgcttctactgcttctgcttctcctgtgaatgctgctgttcaagcttctaaccagacctctgctcctactagccttagcacttctggcctttctgcacaaaccgttctcaacaccatgatggctgtcgttgctgacaagactggttaccctgctgagatgctcgagctcaccatggatatggaagctgatcttggtatcgactccattaagcgcgtcgagattcttggcactgttcaagatgaacttcctggtcttcccgaacttaaccctgaggatcttgctgaatgccgcactcttggcgagattgtgtcttacatgcaaggccaacttggaatgcctgctgcctctatcactaccgcacctactcctactcctgttgacacttctgctcttcctcctcattctggtgttgctcttaagaagcttcctgctgctgataagcttgaagcctgctactctaccgattcttgcatcgttatcaccgacgatggccacaatgctggtgttcttgctgagaagcttcacgctaagggccttacagtcgccgttattcgcaaccctgacaccatttctgttgctcactctcctctctcttctgacatctcttcctacaccctttcttccattgacgatgctgagattgccaaggtcatcaaggctattaccgctactcaccctattgcaggctttgtccacctccaaccacagttcaacgctaactccaaggacctcgtttcctgcaacgttgccgctaaggctgctgttgataacgcttttctctgggctaagcaccttcataccgagttctctaagccacttcaatcacgcctctcttacgttaccgtttctcgcattgatggcggttttggttaccttaactctgccgctctttctaaggccgagcttaaccaagctgcactttctggtctcaccaagacactcagccacgagtggcctaacgtcttttgtcgtgctctcgacatcgctaacgacatcgatgctaagacctttgctaacgccattatcgctgagctctttgacgtgaatgctgctgctcctaatgctaaacgtcttaccgaggtgggtatttctcctcaaggtcgtgctacacttgttgctgccaagaacaacacctcccactaccctgccgttgtgcttactcaacaggacacccttcttgttaccggtggtgctaagggagttacttttgagtgtgctcttacccttgctaagcaatgccagtcccactttgttcttgctggtcgttctcaacatctcggaaaggatatgcctgcttgggctcaaggtaaacaggcttctgagcttaaggctgctgctatctcctacatccagtctcaaggcgaaaagccaaccccaaagcagattgacgcccttgtttggcctgttcagtcttctcttgaaattgatcgcgccctttctgcctttaccgaagttggcgcttctgctcaatacgttgctatggacgtctctaaccctgatgctgttaaggctgctcttgctgctctcactgatacaaacggcaagaaccgcgttattaacggagtgattcacggcgctggtgttctcgctgataagcacatccaggataagacccttgatgaactcaaccgcgtgtactctactaaggttaccggtgtggcttctatcatcaacgctctcgatcctcagcacatcaagcttgtggccatgttctcttccgcagctggattttacggtaacacaggccaatctgattacgcaatgagcaacgagatcctcaacaagaccgccctcaagcttgcagcacaacttcctcaagcaaaggtcatgagcttcaattggggtccttgggatggtggaatggtttcttctgcactcaagaagatgttcgttgagcgcggcgtttacgtcatccctctccaagcaggtgcaaaccttttcgcacattctcttctttctagccagtctgtgcagatgcttatcggtagcgacatgcagggttctgctactcaggatacaaccgctaagaagcctaacgctaacaccctccctcatgctgaaggttcactcacattttctgctccttattgggccgctgatacccagaccgttacagttacccgcgttcttcaacctaacgagctcgtttttgttaacgatcaccgcattgcaggtaacccagttcttcctaccgtttgcgcaatccaatggatgcgtgagacagctcagactctttgccacgtgcctgtgtctattgccgactacaaacttcttaagggcattatcttcgacaccgaccaggctcaccttcttcagctccagcttacccaaacaggtgcaggacttaatgcactcatctcttctcgtgctcttaacgaacctgatgcagctatgaagcctcaataccaagccaccctcgtcgtcaatgacgctcttacccctaccgctgttgctcagtcttctcttcctgctacagttcttcaaaaacttgctcaggtccccgctattcatgctggcaacaccctttaccagaacggcactctttttcatggtcctcgtcttcaaggcattaagcaggtcctctctttcgatgatgagcaacttgtgtgccaggtcaagcttgcccagattaaccccaacgattgccctggctttgctccttctgctgtttcaggtggttctcagatttttgccgaggatcttctccttcaggctatgcttgtttgggctcgcctcaagtatgatgcagcttctcttccttcttctatgggccagtttattaccgttgccccttttgcttctggcgatcaaggctacatccaactcgaggtcatcaagcactccggtcgcatgcttgtcgctaacgtttctctctaccaccaagatggtcgtctttcttgccaaatgcgtgaagctaagatcaccatctccaagacccttaaccaggcattcatcaaccaacacgagaaccaacacgaaaaccagcacgagaacgagcacgaaaaccagccagcaaaccagcactctaaggacagcgtctga

SEQ ID NO: 12 - DNA, 2079 bp, Artificial Sequence
  synthetic codon optimized gene based on Shewanella oneidensis pfaB gene sequence
  misc_feature: SGI cDNA ID NO. 1258278-co886
  misc_feature: codon-optimized DNA sequence for expression in chytrid
  misc_feature: Encodes the peptide sequence at SEQ ID NO 4
  misc_feature: Useful for modulating production of PUFA
atgacccttagcgttaacgctatgtctgctgatcagcaagctgctcttaccgctgaccttaagcaacaacaggctaagcctatgcgccttgcacttcttcttgctgctcctaacacaaagcctgctaaccacctttctctctctgaactcgctgtggattaccaagccattggcactcagactcttgaggctctccttatcaacgctgcttctcttcttggcaaccaacaatgcgacatcgtgtctctcggcaacaaactctggatcatgcaagctatcaccgctgctaagaacggtcttcacgctcatgcttacctcaacgcaattggatgcggtgataactctgagcaggcaattaaccaggctctcgttcacgctaaacgccagcatactcaacctcaggtcgttgaacttactcaggctaacaacgctctcaacgctctcatcgctctcattaacgatatcacatgccgccgtatgcctaactctcaggactactggttcactcctgcacaccaatctcgtgttgcttctctttgctacccttctaacattggcgtcctcgctctcgttttcacccaaggctctcagcttctttctgctaagcctcttcttgctgctaaccgccttatgcttcctctctctgctcactctatttctcaactccacactcgccttacctctctttgcgatgctctctctaagccttgcgatgagctttctctcctcaagtttatccaccagcaatggcaacagtaccagtctcaggccccttacgctctcgttcttatggcaacttctcaatctggccttcaacaagaggcttccgctatgctcgaagctctcgatactcaacaaacccaaaacgcctctaccctcaacaacaccagcttccactacaagacccctgttggttcttgctttactgcttctcctcttggagctaagggtctctctttcgtctaccctggcgttggcactgtttaccctcaaatgtttagccagcttggtcacgtctttcctcacgtcttcgcaaagcttgaagcagaaggcaatcttcctgctatgctccaaacacaggccatctacgcaactcaggagaagaccaacagccatatgtctctttctgaactcgcaattgctggtgttggcgcaagctacatgctctccaagatcctccaggacgagtttgctattactcctgcattcgcactcggttactcaatgggcgaagctgctatgtgggcttctcttggtgtttggcatgctcctcatcacctcattaacgctacccagaacagctctatcttcaaccaggatattgcaggtgaacttcgttgtgtccgccaagcttggcaacttaccaacgatcagcctatcgtgtggaactctttcgttacacgcgcatctgttgcagagattcgtcctcacctcgctaactatcctcgcgttcacatcgccatcattcagggcgattctcttgtgcttgctggctgcgaagaatctattaaggcacttcttaagcaagctggaaaacgcggcattgcagctaaccgcgttactgctatgcatacacctgctgctctcaacattgttgacgacgttaagcagttctacctccagcctcttgctgctgctcttcctactgctacccagtttctctccgctgctcaaactcaacctgtggagcttacctctcatgctattgctaagtctattgctgataccttctgccaccctctcgacttctctcagctcatcaagcagtctatctctcagggttctcgcctttttgttgaagttggcgctgatcgtcaaaccgctaccctcattgacaagatcatcggccagcagacctctcaagtgcctgctcaagctcttgccgttaacgctaagggtgctgatgatatttcttctctccttaaatgcctcgcacagctcatgacacaccgtgttcctatgtctcttacccctttcatccagtctcttcaagatgtgatcaacgacaccctcttcatcgacaccaagcactctcctcttggcttctccgacaccctctctgaaggcgaacctcactga

SEQ ID NO: 13 - DNA, 5790 bp, Artificial Sequence
  synthetic codon optimized gene based on Shewanella oneidensis pfaC gene sequence
  misc_feature: SGI cDNA ID NO. 1258274-co886
  misc_feature: codon-optimized DNA sequence for expression in chytrid
  misc_feature: Encodes the peptide sequence at SEQ ID NO 6
  misc_feature: Useful for modulating production of PUFA
atgtcttctcaggctacccctaagatcgctattgtgggtctcgctaaccaataccctgacgctgatactcctgctcgtttttggcagaacctcatcgacaagaaggattctcgctctcagatctctgcacacaagctcaacgcttctccatctgactacattggcgttcaaggccaatctgaccgcttttactgcgataagggaggctacatccagaacttctctttcaaccctaacggctaccgcatcaactctggcgcttttgagggccttgacgactcttttctttgggctactgatactgctcgtaacgctcttgctgatgctggcattaacgacctcaaccatccttgtcttcaacgtaccggcattgttatgggcaccctttcttttcctaccgctaagtccaaccagcttttcgttcctctttaccacagcgtggtcgaaaaggcattgcagaccaagctccagcaacctcactttgtgctccaagatttcggcctttctcctcagactgagcagtacaattggcgtaacggagctgttgcacataacgctagcaagcttgttgctgacgctcttggtcttggaggtgctcaacttagccttgatgcagcttgtgcttcttctgtttacgctcttaagcttgcatgcgactacctccataccggcaaagcagacatcatgcttgcaggtgcagtttctggagctgaccctttcttcatcaacatgggctttagcatcttccacgcctaccctgatcacggtatctctgccccttttgactctaactctaagggcctctttgctggtgaaggtgctggtgttcttgttcttaaacgtctcgaggatgctcaacgtgacggcgatcacatttacgctctcgtttctggcattggcctctctaacgacggtaaaggtcagtttgttcttagccctaacagcaagggccaggttcaggcttttgagcgcgcatatcgtgaagcagctgcttttgattcttctattacccctgccagcattgaggttattgaatgccacgctactggtacccctctcggcgataaggttgagctcacatctatggaacgcttctttgagggcaagcttaacggctctgctactcctcttattggatctgctaagagcaacctcggtcacctccttactgctgctggtatgcctggcattatgaagatgattttcgccatgcgtgagggtgttcttcctccttctatcaacatctctgcccccatcgcttctcctaacggcctttttggtcaggctactcttccttctgaagttcaaccttggcctgataaagctggcaacaactctcgtcatgctggtgtctctgtgttcggttttggtggctgcaacgctcaccttcttcttgaaagctactctgataccgctgttacctcttctactcctactcagctcgtcaacgcttctgagcagcctatgcacattactggcatggcagctcactttggacaatgctcttccatcaaccaactcgctgaacgtattcgtgctaagcagcacctcttcacccctcttcctactcaacgctggaagggcattaacaagcatcctgaacttctcaccaagtacggtcttgaacaagtgcctcaaggtgcctacatcgaccagttcgactttgactttctccgcttcaaggttcctcctaacgaggatgatcgcctcatttctcagcagcttctccttatcaaggtggcagacgaggccattgtgaacgctaagctcaaccctggctctaaggttgcagttcttgttgctatggaaaccgaacttgagcttcaccaatttcgcggccgtgttaaccttcactctcagcttgctcagtctcttactgctcagggtattgaactctccgacgacgaataccaggctcttgaggcaattgctatggactctgtgctcgatgctgctaagctcaaccagtacaccagcttcatcggcaacattatggcttctcgcatttcttctctttgggactttaacggccccgctttcaccatctctgctgctgaacagtctgttaatcgctgcatcgatgttgctcagaacctcttcgctatgggctctcttcaggaacctcttgacgctgtgatcattgctgccgtcgacctttcaggctctatcgagaatggtctccttaattctgctaacctcaagcttgctggacttcaaactaacaacgtgcagatcggcgaaggtgctggtgctattgttcttcagcagacccaccttaacgactcttacgcctctatcaactctgtgcagttcgccaagcaagagcaggttacccttaagcagacctgcgacatcaacgagctcaacattgcccctctttgccaacaatctgatcttggacagcagcttactcgtcaacttgctcaacttgctgatgcctcctctatctcttctgttcagcctcttctcggtcacacctttgcagcttctggtatggctagccttcttaacgccctcattcagtctcaacagctccaacaagccgacatttctgcccaggttatctctgccagcgaaaaccagtattcacgcattggcctctctcttaacactctccaacaacaagctctcgctaaccgccttactcaaactctcacagagcagctcaccaagtctgcaaagctttctctcatcaagcaggtctctcttggtggtcgcgacatttaccagcacatcgtcgatactcctgtggccgcaattgacaagatgatctctcagtgtgcttctatcaagcgcgagacagttcagcaagctcctactaacatgaacatcaacgagcctaccatgccagctagccacttcgcccctattccaggtactccaggtcaaactcctaataacactcacagcacccaagccatttctcaagcaatccctccagctcacctcaccgcttttgagcaaaatcagtggcttgcacaacaagcacacctcgcttttcttgcttgccgtgaagcaggtcttaaagttgctgataacctcctcaagtctcagctcgcctctatcacctctgcagctaccgctcaaactattgctcctgcacttacagccaaagttcctgcagaacactacgtcaagcctcagtctgttctcgctgaacgtaagcctaaccatgctcaagttcctacctacactgctcctactcctgccgataagccttgtatttggaattacgccgatcttgtggagtacgccgaaggcgatatcgctaaggtgttcggtcctgattacgccatcatcgactcttattctcgtcgtgttcgtctccctactaccgattacctcctcgtttctcgtgtcaccaagcttgatgctaccattaaccagtacaagccctgcagcatgaccacagagtacgacattcctgttgatgcaccatacctcgttgatggccagattccttgggcagttgcagttgaaagcggccaatgcgatcttatgcttatctcttacctcggcattgacttcgagaacaagggcgaacgcgtttaccgcctccttgattgcactcttacctttcttggtgaccttcctcgtggtggtgatactcttcgttacgacatcaagatcaacaacttcgctcgcaacggtgataccctcctcttcttcttcagctacgagtgcttcgtcggcgataagatgatccttaagatggatggtggttgtgcaggcttcttcaccgataaggagctcgcagacggcaagggtgttattcagacagaagacgagatcaagcttcgccaacaggttctcaacaaccctaataagcctacctttacccctcttctccactgccagcaaactgcctttgattacggccagattcaccaccttctcactggcgatattggttcttgctttggaggtgctcacgtttctcaccagcttcagaccggcatgcagaagtctctttgcttcgcttccgaaaagttcctcatgattgagcgcgtgtctaatcttcaaacccatggtggtacttggggtcttggacttgttgagggtcataagcagctcgcacctgatcattggtacttcccttgccactttaaggacgatcaagtcatggcaggcagccttatggctgaaggttgcggccaacttctccagtttttcatgctccacattggcatgcatacccttgtcgagaatggacgttttcaacctctcgagaacgcatctcagaaggttcgttgtcgtggtcaagttctccctcagcatggtgagcttacataccgcatggaagttaccgaaattggtacctctcctcgcccatacgctaaggctaacatcgacatcctccttaacggtaaggtcgtggtggatttccagaacctcggtgtgatgattaaggaagaagcacagtgcactcgctacctctctcacacaagcactaacgctaacacaggcaccagcatcaagcctactaaggttgctgacacaaacgttaacaacgctgcatctcagcaggacgctgcacctcttatggcaaagattgctgacacttctgctcctaccaacaagggcgtgattcctctcaagcatgttgaagctcctcaggtttctgcagactctaagtacgctaaccgtgtccctgataccctcccttttaccccttaccacatgttcgagttcgctactggtgatattgagaagtgctttggccctgacttcagcatctacaagggtctcattcctcctcgtactccttgcggtgaccttcaacttaccactcgcgttattgacatcaacggcaaacgtggcgagcttaagaagccttcatcttgcgttgccgaatacgaggttcctgctaacgcttggtactttgccaagaacagccatcctgctgttatgccttactctgtcctcatggagatttcccttcaacctaacggcttcatctccggctacatgggcactacactcggctttcctggtcaagaactcttttttcgcaacctcgacggacatggtactcttcttcgccacgttgatcttcgtggtaagaccatcgtgaacgattctcgccttctttctaccgttattgctggcagcaacatcatccagaacttcaccttcgacctttccgttgatggcgagcctttctacactggtggcgcagttttcggctacttcaaggctgatgcacttaagaaccaactcggcatcgacaatggcaagattacccaaccttggcacgtggacaacaacgttgcagctgataccattgtgaaccttcttgacaagcagtctcgcctctttaatgctcctgctcatcagcctcattaccgccttgctggaggtcaactcaacttcatcgacaccgcagagatcgtgaacaatggtggcaagtacaagcaaggctatctcgctgcttctcgtaccattgacccttctgactggttctttcagttccactttcaccaggatcctgttatgcctggttctcttggcgttgaagccattatcgagctcatgcagacatacgctatcaccaacgaccttggagctggtttcgctaaccctaagttcggccagatcctctctgacattaagtggaagtaccgcggccaaatcaaccctctcaacaagcagatgtctctcgatgtgcacatttctgctgtcaaggatgaaaacggtaagcgcatcatcatcggcgatgctaacctcagcaaggatggtcttcgcatttacgaggtgaaggacatcgccatttgcatcgaggaggcctag

SEQ ID NO: 14 - DNA, 1629 bp, Artificial Sequence
  synthetic codon optimized gene based on Shewanella oneidensis pfaD gene sequence
  misc_feature: SGI cDNA ID NO. 1258275-co886
  misc_feature: codon-optimized DNA sequence for expression in chytrid
  misc_feature: Encodes the peptide sequence at SEQ ID NO 8
  misc_feature: Useful for modulating production of PUFA
atgactacccagctcaagaacgagaagctttctccttggccttggcaggtttctcagcagcatgtgtctttcgatcctgctggcattaacaagaagctcaaggacctctctcaagcttgctacgtggtgaacgatgctcaacaaggtcttggtgttgctcaacaagcacaggttgtgaccgatactatcactaacgctcacgctctccctgtttctgcttttgctccagctctcggtacccagtcacttggcgattctaactttcgtcgtgttcacggtgtgaagtacgcatactatgctggtgctatggctaacggcattgcttctgaggagctcgttattgctcttggtcaagctggcattctttgctcttttggtgctgcaggtcttattccttctcgcgtcgaacaggctattaagcgcatccaggcagctctccctaacggtccttacgcttttaacctcatccactctccttctgaacctgctcttgaacgtggttctgttgagcttttcctcaagcacaaggtgcgtactgttgaggcttctgcatttctcggtcttactcctcaaatcgtctactatcgtgcagctggactttctcgcgatgctcaaggtgacatccagatcgacaacaaggtgatcgccaagatctctcgcactgaggtggctattaagttcatgcaacctgcccctgtcaagatccttcagcaacttgtcgatgagggccttattacccctgagcaaatggctcttgctcaacttgttcctatggctgacgatattactgcagaggctgattctggtggccataccgataaccgccctcttgttaccctccttcctaccattctcgctctcaaggacgaagttcaagcaaagtacaactacaagacccctattcgcgttggtgctggtggcggtgttggtactcctgatgctgctcttgctacttttaatatgggtgctgccttcattgttactggctctatcaaccaagcttgcgttgaagctggcgcttctgagcatacccgcaagcttcttgctactaccgagatggccgatgttactatggctcctgctgctgatatgtttgaaatgggcgtgaagctccaagtggtgaagcgtggaactctcttccctatgcgtgcaaataagctttacgagatctacacacgctacgactctattgaggctattccttctgacgagcgcgaaaagctcgagaagcaggtgttccgttcttctctcgacgacatctgggctggtactgttgcacactttaacgaacgtgaccctaagcagattgaacgcgccaaggacaaccctaagcgcaaaatggctcttatttttcgctggtaccttggtctttcttctcgctggtctaacacaggtgaaactggacgcgagatggattaccagatttgggcaggtcctgcacttggagcctttaacgcatgggcaaagggctcttaccttgatgattacacccaacgtcatgctgtcgacctcgctaagcaccttatgcatggtgctgcttatcttgcacgtgttaaccttcttgctgctcaaggcgtttctcttcctgttgctcttcaacgttggcgtcctgctgatcaagttaagtag

SEQ ID NO: 15 - DNA, 918 bp, Artificial Sequence
  synthetic codon optimized gene based on Shewanella oneidensis pfaE gene sequence
  misc_feature: SGI cDNA ID NO. 1264359-co886
  misc_feature: codon-optimized DNA sequence for expression in chytrid
  misc_feature: Encodes the peptide sequence at SEQ ID NO 10
  misc_feature: Useful for modulating production of PUFA
atgcctattcacgctgctgtgaactctctctaccctttcaccaagagctacatctacttcgtgagcctcaacgctcagctttctgctgctgacttcgataagggccttgctcttgcttggctttctcctgatgaagctgctaaggttgctcgctacaagtctccttctgctcgtaacaacgctctccaagttcgtcttgcacttcgtgctattctttctcgccattctgctgtcaatcctgctcaatggcaattcacatacggcgaaaagggcaaacctgctctctcccaagagtggttcgcaaagaccggcctctactttaacctttctcactctggacaatggctcatgattggcgtgatcacaggcaccaaatgcaaccttagcaccgactttcagggtcttgatgagctctttgttggcgtggatattgagcgtgagcgttcttctaccgatatcgttcctattctccaccactacttcacccaggcagagactgacgccctccttcaactccctattgagcttcaacgtcaacgcttctttgacctttgggcagtgaaggagtcttacattaaggcacgcggtcttggtcttgcactttctctcaagtctttcagcgtcgacttttccgctaccgttctttctaacgctacccttaagctccccgataactcctctaagatgatccccatgttcgagcccgtcaagctttccttctccgacgctaacgatcctgcagctactgatgttacttggcagactcttatgggtcgtctcaacgagggttaccgcttttctatgacacttggcattcctcgtcgtgtttacaactctatcgacctccaatctggcagcatcagcaacacccttacttgcgttcaacttgaactcggcgacctcctcaacaacaagtag

SEQ ID NO: 16 - DNA, 997 bp, Aurantiochytrium sp.
  misc_feature: alpha-tubulin promoter
ggagggaggcatgaaaacaaagttgttaaaactaaacgaggcgaaagaaagcggcggagcaatggtagacacaatatgagtaggtagcaggtccctacagccagccactcaatcatacgaggagtctatgcaggggtgctagtattttatagtatctggatgctaagaggcacgacttcttccgcctgtctgtttgtctatctggctacccctattgtatcttatatcctaaacactagggctccctcaccagcaacagtcagtcactcacgcattcagtttatactaaggctcacctagactaatccataagcagccaatccgttccgcgctcgcgccggtagaagcaaccggaccatacggaggtcttaatgtttaggttatatggactatgtcttatcggtgggccgttatacacgccgcgctggaagctcctctactttgtgaggagtttcacttataatgaatgatcgggattcctgttcccctcccatccactgggtgcaaaactcaactccctcacaaaaagtgtattctataaatatatgtaaaagcaacggtcgctacctctaagtacactgatgatataaacaagagcaagatggaagttttcagtgtttgttgtgaggaacagcactggaggccaaaacaagcctcttagaaagttctccactggcaagcttcgacggtttggcgcagagtgagggcagcaaactttgccgcatcgcagcaaatctcaatcagccttttgacggtcgtgcctaacaacacgccgttcaccccaagccttactttgccttcgtgcattgtcctcgagtatcgtaagtttgattcgctttcattcgcttccatccactccggttgtagcaaaagcaaagcagcgttgtgcggctctcaaggtttggccctgatgcgaccgacgagcataaactaactagcctccgtcttggtttcgtttcacagtaaagtagttttcgaaactccaacctcaagcaaa

SEQ ID NO: 17 - DNA, 8154 bp, Shewanella hafniensis
  misc_feature: SGI cDNA ID NO. 1257571
  misc_feature: PfaA gene
  misc_feature: Encodes the peptide sequence at SEQ ID NO 18
  misc_feature: Useful for modulating production of PUFA
atgagccataccccttctgtacctcattcaaccactgactcaaaagctgagtcaaaaaaagataaacgcctcaacaaacgtttaaaagatatgcccgttgccatcgtcggcatggccagcatcttcgctaactcgcgttatttaaataaattttgggatttgatcagcgaaaaaatcgatgccatcactgacatcccagacacccattggcgcgccgaagattactacgatgccgacaaaagcaaagccgataaaagctactgtaaacgcggtggttttttaccagaagtcgacttcaatccaatggaatttggtctgccacccaatattcttgagctgacagatacctcgcaactgctgtcgctgattgtcgccaaagaagtgcttgccgacgccaatctgcccgccgattatgatcgcgatcgtatcggcatcacactaggcgtgggcggtggtcaaaaaatcagtcagagcttgaactcgcgcctgcaatatccagtattgaaaaaagtattcaaaagcagcggcctgagcgatgaagacagcgaaatgctgatcaaaaagttccaagaccaatatatccactgggaagaaaactctttcccaggttcactcggcaacgtgattgcaggccgtatcgccaaccgttttgattttggcggcatgaactgtgtggtcgatgcagcctgtgcgggctcgcttgccgctatgcgtatggcgttgactgaactgaccgaaggtcgcagcgacatgatgatcacaggcggcgtctgtaccgacaactcgccgtccatgtacatgagcttctcaaaaacgccagccttcactaccaatgaaaccattcaaccctttgatatcgattcaaagggcatgatgatcggtgaaggtatcggcatggtcgcgcttaagcgtcttgaagatgccgaacgcgatggcgaccggatttatgccgtcatcaaaggcgttggcgcctcatcggacggtaaatttaagagtatttatgcgccgcgccctgaaggccaagctaaagcattggagcgcgcctacgacgacgcgggttttgccccgcacagcattagcttagttgaagcccatggcacgggcactgccgcaggtgatgtggctgaatttaatggtttaaaatcagtatttgcccaaggcaacgacaccaatcaacatatcgcgttaggttcagtgaaatcccaagtgggccacacaaaatccaccgcaggcactgcgggggtgatcaaagcagcgctggcactgcaccacaaggtattgcctgcgaccattaacgtcagtaagcccaatccaaaactgaatattgaaagctcgccattctatttaaataccgaaacgcgcccttggctgcaacgcactgacggtacgccgcgccgtgctggcataagctcctttggttttggcggcactaacttccacctcgtattagaagaatacaaacccgagcacagccgtgatgagcagtaccgtcagcgcagtgtgccgcagacgttattgtttgccgccgccaataacgccgcgctgcttagcgagttaaaagctgcgctgagccaaagcgtgaatacgaacgcgaataagagcagcgctgtgagcctgaacgctatcgctcagcaatatccgctgcgcgcgctggcagacacagatgcccgtttaggttttgtggctaaggatatcgctcagctgcaagctcagttgaatcaagccatctctcatctagaaagcagtgcgcatttagaaagcagtgcgcatttagaaagcgggcacctagaaaccagtgtcagcgaggcgtggcagctaccttctgggatcagctaccgcgcaaaagctttagttgctaaagatgaatcaaagaaagtggccgctctgtttgccggtcaaggttcacagtacctgaacatgggccgcgaactcgcctgccatttccctgaaatgcgccaacaagtgatggccagcgataaggtatttgctcaccatggccaaacgccgttatccaatatcctctaccctattccggcattcgatgccgatgcggttaaagcccaagaagcggcgctgactaataccctgttcgcccaaagcgccataggcgcggtttcaatggcgcaatattcactattaactcaggcaggttttacccctgatatggtggcgggccatagctttggtgaattgtcagccctttgcgcggctggcgtgatttcgagtgttgattacgtcgaactggccttcgcccgtggacacgccatggcgcaaacgccaaatgatactggcgctcaagtcgatttaggcaagatgtttgccatcatcctcaaacaaaagagtgatatcgatgcgcttaatcgctgtttagctcagtttgatggcgttaaaattgccaactacaatgcgccgacgcaattagtcatcgcaggtggcacagagcaaactcagctggccgccaaagctattagcgaactgggctttaaagcgattgccctgcccgtttctggcgcgttccatacccccttggttggacacgcacaaaagccatttgccaaggccattgataaagctaaattcagcgcgccttcaatcgcactttatgccaacggcacgggtcaattgcacccaagcgatggcaaagcgattaaagcagaatttaaacaacacatgctgcaatcggttcgttttagcgaacaactgcaggccatgtatgatgctggcgcccgtgtttttgttgagtttggccctaagaacatactgcaaaagttagttgaaaataccttaggcgaacacttaaatgagctttgccttgtcagcatgaacccgaaccctaagggcgacagtgacagtcaattacgcttagccgcagtgcaactcgcggtagccggtgtggcgttaactgaggttgacccctatcaagccgtcacgtcacaggagattgccgagcgtgaagcgccatcggcgatgaacatcaaactcaccgccactaaccacatcagtgccgcaacccaagctaagatggcgaaatctctcgccacaggcagcgtgactagccaagtgcaatatgtggatcgcatcgttgaaacggttgtcgaaaaagaagtcgaaaaaatcgttgagaaagaagtcatagtcgaaaaagtggttgaaaaaataatagaagtggaagtgaatcaagtggcagctgttgaaatgaaacaaaaactcccaagcgtgacgcaaggcttaagcaatcaccagcaacaagcgacggcgcaattgaactcaagcgtcagcggcgatgcattaacggcatttttcagcgcacaatctcaagcggctcagttacatcaacagtttttagccatcccacagcaatatggcgataccttcacgacactgatgacagaacaagccaagatggcaagccttggcattgcaatccctgaaagcctgcaacgctcgatggagatgttccaccagcatcaagcacaaaccctgcaaagccacgccgaatttatgcaactgcaaagcagtagcagccaagcggccttggccatgctaaacaatgcgccgattcactttactccagcagttgcaagtcagccacgagcaactgcaccggctcctgttgcagcaactgtacacaatgccgcaccagtcgcgattcaggctgttgcgacaagacctgcggttagcacacctgttgtgcaaaccgctcccgttgcttatacgcctgaggtaacagtacaagtggcgcctgaattagttatgcctgctgtggtgatgccagaagtgacacctgtggcaccaacaatgaacggtttaagtgctgaaaaagtacagcaaactatgatggctgtggtggccgacaagactggctaccccactgaaatgctagagcttggcatggatatggaagccgatttaggtatagattcgattaagcgcgttgaaatcttaggcacagtgcaagacgaactaccaggcttacctgaactcagcccagaagatttggccgagtgtcgcaccttgggtgaaatagttagctatatgaatagcaaattacctgcagcgggagcgattgcttcgacagcagcgccagttgttcaaaccattgccgctcctgccgccagcggtttaagcgctgcgttagtgcaacaaaccatgatggctgtggtggccgacaagactggctatcccactgaaatgttggagctcagcatggatatggaagccgatttaggtatcgattcaattaagcgcgttgaaattttaggcacagtgcaagacgaactgccgggtttaccagagctcagcccagaagatctggccgagtgtcgcaccttaggtgaaatcgttgactacatgaacagcaaattgccagtagttagcgtggtagcagttgcaccaccggcaaacgttgaagcaacgactgcacaagttccagcgaataacggtttaagcgctgccttagtgcaacaaaccatgatggctgtggtggctgacaagactggctatccgactgaaatgctggaacttggcatggatatggaagccgatctaggtatcgattcaattaagcgcgttgaaatcttaggcacagtgcaagacgagctgccgggtttacctgagctcagcccagaagatttggccgagtgtcgcaccttgggtgaaatcgttaactacatgaacagcaaactgccagctgtgggatcagttatcgtagcaactcatgtgacaactgccgcgcctgccgccagcggtttaagcgctgcgttagtgcaacaaactatgatggctgtggtggccgacaagacgggctatcccactgaaatgctggaactgagcatggatatggaagccgatctaggtatcgattctatcaagcgcgttgaaatcttaggtacagtgcaagatgagctaccgggcttacctgagctgaatcctgaagatctggccgagtgtcgcaccttaggcgaaatcgttgactacatgaacagcaaattgccagtagttagcgcggtagcagttgcaccagcggcaaaagttgaagcaacgccagcacaagttccagcgaataacggtttaagcgctgaaaaagtccaacaaaccatgatgtcagtggtggccgacaagacgggctaccccactgaaatgctggaactcagcatggatatggaagccgatttaggtattgattcgatcaagcgcgttgaaatcttaggcacagtacaagacgaactaccgggcttacctgagctgaatcctgaagatctggccgagtgtcgcaccttaggtgaaatcgtcacgctgttctcgcaagatttagggcaaagcaagctagaccaaaacgtggcaagccagaatacagctgtagttagtgctgtcgttcagcctgaacctactatcgatttaccaccacatgatttaccaccccatagcgaggtggtgctaaaaaagttgccagcggcggctgagctaacgcaactatcgccacagcaatcgtcaaagcaatcagcgcaacaagctcaaacacgcgtttttgctaaagatgcctgcattatcattagcgatgatggtcacaatgctggcgtacttgccgagaaattgcatgctcaaggtctaacggttgcggttgtgcgctcgccagaaagccttgtagccagtgcatcaccgctcaatagccacattgctagcttcacattggcggcgattgacgatgccagtatcagcgcagtaattaatgagatcaaaagcttaggtacagttgcaggctttattcatctgcaaccacaacataaaacctcagccgatgcgaaaggtttagtgttgtccaatgccgccaaagcgtcggtcgagcaagcgttcttgttcgccaaacacttacaaccgcttttaacaacagcagcaacggcaaatactgatagcagctttatcagcgtcagtcgtatcgacggtggttttggttatcttaaccacagccaaattgcccgcagcgagttaaaccaagcggcattagcaggtctgacgaaaaccttgagccacgagtggccaagcgtgcattgccgcgccttagatatcgcgccagcacttgatgccaaacaactggccaatgcggtcatcgctgagttatttgcaaccgataagctattagaagtcggtgtgagtgaagcaggcgcaacagaaacgctagcacgcgtaaccttagttgcaggcaaggcagatacccgccacagcgcagctaacttgaccagtgcagataaaattctagtgaccggcggcgcaaaaggcgtgacctttgaatgtgccttgagtctggcaaaacgcagcaaggcgcactttatccttgctggcagaagcagccaacaagcgattcccgcttgggcacaagctaaaaataacagcgaacttaaagccgctgccattgcccacatccaaagcttgggcgagaaacccaccccaaaacaagtggatgccttagtatggccagttcaaagcagccaagaaattgcagcagcactgcaagcctttaccgcagtaggcgcgagtgccgagtacttaagcctcgatgttaacaatccagacgcgatcgccagcacgatagtgccgatcaccgagttatcacctattaccggcatcatccatggtgcgggcgtactcgccgataaacacatccaagacaaaaccttagatgagttagcacgggtgtatggcactaaggtcacaggcattagcaatctgcttgccgcactggatttagataaagtaaaactgattgccctgttctcttcggcggcgggtttttacggcaataccggccaaagcgattacgccatgtccaacgacatactcaacaaagccgcactgcaactggcgcagcaactgccaaatgctaaagtgatgagctttgattggggtccgtgggatggcggcatggtgaatcctgcgctgaaaaagatgtttatggatcgcggtgtttatgttatcccgttaaaggcaggtgctgagttatttgcgagccaattactgagcaacacaggcgcacaattgctggtcggtactgacatgcaaggcagcgcacctcatgacgacacttctaataaagtgcaagagactgaaggtagcaatctaaaaaagcctgaagcggttctgaccacagactcgtcgggtccgcatgctttgcctaacgctgtaaatccaagcgctgtaaatataagcgctgtaaaactgcagcgcacactggaccctaaggcaatgatctttattgaagatcactgcattaacggtaatcccgtattaccgactgtgtgcgcgattcagtggatgcgtgaagccgcctttgatgtgctcaagcaaccagtcaaagtgcaaagctacaagctgttgaagggcattattttcgacactgccgtgttacaaaatggagtgttagaaagtgcagtccccatcacgctacaacttgaacttgcaccgattgcattaacggataaagccgcgaaagacacagacgagtacttgagtggacaattcagtgccttaatcagctttgaaggtcgtccgcaatatcaagctattttagtggttgatgacacggctagcagctttaacaaagcaactgcttttgacgcgcaaagtttggcgggactttctgccatcacaaccgcgagccgcctttacagcgacggcaccctgttccacggcccaagactgcaaggtattgagtcggtggtgaagtttgacgatgcgagtttagtcgccaaggtgagcctaccccatgttgcgttagcagactgcgggagttttgcacctaatctcacccctaaaggctcacaagcctttgcggaagatttgctgttgcaggcgatgctcgtatgggcacgtctcaactatggcgcggcgagtttgccatcaagtattggtgagtttatctcccatgcgccgtttgcctttggcgataaagggtatttagtactcgaggtggtgaaacactctggccgcgcccttgaagccaatatcgcgctatatcatcaagatggccgtttaagctgcgaaatgagcaacgctaaagtcaccatcagcaaaaacctaaatggtgcattcttagccaataaagttgccaataaacttgctaataaaagcattgaaagcgtggaggcaaaagtcgagtga

SEQ ID NO: 18 - protein, 2717 aa, Shewanella hafniensis
  misc_feature: SGI Peptide ID NO. 1257571
  misc_feature: PfaA polypeptide
  misc_feature: Useful for modulating production of PUFA
  misc_feature (1)..(2717): NCBI GI: 304409535 Blast Desc: polyketide-type polyunsaturated fatty acid synthase PfaA [Shewanella baltica OS183] gi|304352053|gb|EFM16451.1| polyketide-type polyunsaturated fatty acid synthase PfaA baltica
  misc_feature (1)..(2717): NCBI GI: 160874571 Blast Desc: polyketide-type polyunsaturated fatty acid synthase PfaA [Shewanella baltica OS195] gi|160860093|gb|ABX48627.1| polyketide-type polyunsaturated fatty acid synthase PfaA baltica
  misc_feature (1)..(2717): NCBI GI: 152999951 Blast Desc: erythronolide synthase [Shewanella baltica OS185] gi|151364569|gb|ABS07569.1| Erythronolide synthase [Shewanella baltica OS185]
  misc_feature (1)..(2717): NCBI GI: 206570564 Blast Desc: PfaA [Shewanella sp. BR-2]
  misc_feature (1)..(2717): NCBI GI: 126173663 Blast Desc: beta-ketoacyl synthase [Shewanella baltica OS155] gi|125996868|gb|ABN60943.1| beta-ketoacyl synthase [Shewanella baltica OS155] gi|334862821|gb|AEH13292.1| polyketide-type fatty
  misc_feature (1)..(2717): NCBI GI: 217974087 Blast Desc: polyketide-type polyunsaturated fatty acid synthase PfaA [Shewanella baltica OS223] gi|217499222|gb|ACK47415.1| polyketide-type polyunsaturated fatty acid synthase PfaA baltica
  misc_feature (1)..(2716): NCBI GI: 113971001 Blast Desc: beta-ketoacyl synthase [Shewanella sp. MR-4] gi|113885685|gb|ABI39737.1| beta-ketoacyl synthase [Shewanella sp. MR-4]
  misc_feature (1)..(2699): NCBI GI: 117921281 Blast Desc: beta-ketoacyl synthase [Shewanella sp. ANA-3] gi|117613613|gb|ABK49067.1| beta-ketoacyl synthase [Shewanella sp. ANA-3]
  misc_feature (23)..(1451): NCBI GI: 75908804 Blast Desc: beta-ketoacyl synthase [Anabaena variabilis ATCC 29413] gi|75702529|gb|ABA22205.1| Beta-ketoacyl synthase [Anabaena variabilis ATCC 29413]
  misc_feature (31)..(308): Pfam Id: PF00109 Pfam Desc: Beta-ketoacyl synthase, N-terminal domain
  misc_feature (33)..(1594): NCBI GI: 282895492 Blast Desc: Beta-ketoacyl synthase [Raphidiopsis brookii D9] gi|281199525|gb|EFA74388.1| Beta-ketoacyl synthase [Raphidiopsis brookii D9]
  misc_feature (316)..(433): Pfam Id: PF02801 Pfam Desc: Beta-ketoacyl synthase, C-terminal domain
  misc_feature (629)..(965): Pfam Id: PF00698 Pfam Desc: Acyl transferase domain
  misc_feature (1279)..(1345): Pfam Id: PF00550 Pfam Desc: Phosphopantetheine attachment site/acyl carrier protein
  misc_feature (1384)..(1451): Pfam Id: PF00550 Pfam Desc: Phosphopantetheine attachment site/acyl carrier protein
  misc_feature (1491)..(1557): Pfam Id: PF00550 Pfam Desc: Phosphopantetheine attachment site/acyl carrier protein
  misc_feature (1593)..(1660): Pfam Id: PF00550 Pfam Desc: Phosphopantetheine attachment site/acyl carrier protein
  misc_feature (1701)..(1765): Pfam Id: PF00550 Pfam Desc: Phosphopantetheine attachment site/acyl carrier protein
  misc_feature (2084)..(2170): Pfam Id: PF00106 Pfam Desc: short chain dehydrogenase
  misc_feature (2084)..(2305): Pfam Id: PF08659 Pfam Desc: Ketoreductase domain (KR)
  misc_feature (2162)..(2290): Pfam Id: PF00106 Pfam Desc: short chain dehydrogenase
MSHTPSVPHSTTDSKAESKKDKRLNKRLKDMPVAIVGMASIFANSRYLNKFWDLISEKIDAITDIPDTHWRAEDYYDADKSKADKSYCKRGGFLPEVDFNPMEFGLPPNILELTDTSQLLSLIVAKEVLADANLPADYDRDRIGITLGVGGGQKISQSLNSRLQYPVLKKVFKSSGLSDEDSEMLIKKFQDQYIHWEENSFPGSLGNVIAGRIANRFDFGGMNCVVDAACAGSLAAMRMALTELTEGRSDMMITGGVCTDNSPSMYMSFSKTPAFTTNETIQPFDIDSKGMMIGEGIGMVALKRLEDAERDGDRIYAVIKGVGASSDGKFKSIYAPRPEGQAKALERAYDDAGFAPHSISLVEAHGTGTAAGDVAEFNGLKSVFAQGNDTNQHIALGSVKSQVGHTKSTAGTAGVIKAALALHHKVLPATINVSKPNPKLNIESSPFYLNTETRPWLQRTDGTPRRAGISSFGFGGTNFHLVLEEYKPEHSRDEQYRQRSVPQTLLFAAANNAALLSELKAALSQSVNTNANKSSAVSLNAIAQQYPLRALADTDARLGFVAKDIAQLQAQLNQAISHLESSAHLESSAHLESGHLETSVSEAWQLPSGISYRAKALVAKDESKKVAALFAGQGSQYLNMGRELACHFPEMRQQVMASDKVFAHHGQTPLSNILYPIPAFDADAVKAQEAALTNTLFAQSAIGAVSMAQYSLLTQAGFTPDMVAGHSFGELSALCAAGVISSVDYVELAFARGHAMAQTPNDTGAQVDLGKMFAIILKQKSDIDALNRCLAQFDGVKIANYNAPTQLVIAGGTEQTQLAAKAISELGFKAIALPVSGAFHTPLVGHAQKPFAKAIDKAKFSAPSIALYANGTGQLHPSDGKAIKAEFKQHMLQSVRFSEQLQAMYDAGARVFVEFGPKNILQKLVENTLGEHLNELCLVSMNPNPKGDSDSQLRLAAVQLAVAGVALTEVDPYQAVTSQEIAEREAPSAMNIKLTATNHISAATQAKMAKSLATGSVTSQVQYVDRIVETVVEKEVEKIVEKEVIVEKVVEKIIEVEVNQVAAVEMKQKLPSVTQGLSNHQQQATAQLNSSVSGDALTAFFSAQSQAAQLHQQFLAIPQQYGDTFTTLMTEQAKMASLGIAIPESLQRSMEMFHQHQAQTLQSHAEFMQLQSSSSQAALAMLNNAPIHFTPAVASQPRATAPAPVAATVHNAAPVAIQAVATRPAVSTPVVQTAPVAYTPEVTVQVAPELVMPAVVMPEVTPVAPTMNGLSAEKVQQTMMAVVADKTGYPTEMLELGMDMEADLGIDSIKRVEILGTVQDELPGLPELSPEDLAECRTLGEIVSYMNSKLPAAGAIASTAAPVVQTIAAPAASGLSAALVQQTMMAVVADKTGYPTEMLELSMDMEADLGIDSIKRVEILGTVQDELPGLPELSPEDLAECRTLGEIVDYMNSKLPVVSVVAVAPPANVEATTAQVPANNGLSAALVQQTMMAVVADKTGYPTEMLELGMDMEADLGIDSIKRVEILGTVQDELPGLPELSPEDLAECRTLGEIVNYMNSKLPAVGSVIVATHVTTAAPAASGLSAALVQQTMMAVVADKTGYPTEMLELSMDMEADLGIDSIKRVEILGTVQDELPGLPELNPEDLAECRTLGEIVDYMNSKLPVVSAVAVAPAAKVEATPAQVPANNGLSAEKVQQTMMSVVADKTGYPTEMLELSMDMEADLGIDSIKRVEILGTVQDELPGLPELNPEDLAECRTLGEIVTLFSQDLGQSKLDQNVASQNTAVVSAVVQPEPTIDLPPHDLPPHSEVVLKKLPAAAELTQLSPQQSSKQSAQQAQTRVFAKDACIIISDDGHNAGVLAEKLHAQGLTVAVVRSPESLVASASPLNSHIASFTLAAIDDASISAVINEIKSLGTVAGFIHLQPQHKTSADAKGLVLSNAAKASVEQAFLFAKHLQPLLTTAATANTDSSFISVSRIDGGFGYLNHSQIARSELNQAALAGLTKTLSHEWPSVHCRALDIAPALDAKQLANAVIAELFATDKLLEVGVSEAGATETLARVTLVAGKADTRHSAANLTSADKILVTGGAKGVTFECALSLAKRSKAHFILAGRSSQQAIPAWAQAKNNSELKAAAIAHIQSLGEKPTPKQVDALVWPVQSSQEIAAALQAFTAVGASAEYLSLDVNNPDAIASTIVPITELSPITGIIHGAGVLADKHIQDKTLDELARVYGTKVTGISNLLAALDLDKVKLIALFSSAAGFYGNTGQSDYAMSNDILNKAALQLAQQLPNAKVMSFDWGPWDGGMVNPALKKMFMDRGVYVIPLKAGAELFASQLLSNTGAQLLVGTDMQGSAPHDDTSNKVQETEGSNLKKPEAVLTTDSSGPHALPNAVNPSAVNISAVKLQRTLDPKAMIFIEDHCINGNPVLPTVCAIQWMREAAFDVLKQPVKVQSYKLLKGIIFDTAVLQNGVLESAVPITLQLELAPIALTDKAAKDTDEYLSGQFSALISFEGRPQYQAILVVDDTASSFNKATAFDAQSLAGLSAITTASRLYSDGTLFHGPRLQGIESVVKFDDASLVAKVSLPHVALADCGSFAPNLTPKGSQAFAEDLLLQAMLVWARLNYGAASLPSSIGEFISHAPFAFGDKGYLVLEVVKHSGRALEANIALYHQDGRLSCEMSNAKVTISKNLNGAFLANKVANKLANKSIESVEAKVE

SEQ ID NO: 19 - DNA, 2019 bp, Shewanella hafniensis
  misc_feature: SGI cDNA ID NO. 1257566
  misc_feature: PfaB gene
  misc_feature: Encodes the peptide sequence at SEQ ID NO 20
  misc_feature: Useful for modulating production of PUFA
atgtatgaaccaaggtcgcttactgtattattgagccaagctgtggcggccattgagcaaggcaagctcgttgaactgatatttaatgatggcaatctgccccagtctctgtacttgctcgatggtttaatcgccgccaaactgcgccttcacgcccacgcgttcattgcaggctttgccgctggcaatggggcgacaggtgacgtgaatgcggctgttgctaatgcggcagctgttgctaataaggcattaggggcggcaaagcgcaatccagcacaaaccgttcagcatcagatggtcgccaacacgctcaacgaagcatgtattgcgctgcgccaaggcgtaaccgccctcgccgcacgaacacaagcgccgctttatggcaaagaaggggaaaatcagcaaacgggctattggtttagcgaccaacatcaagcacgggtgttgtgcctaaattttgtcgcaaaaacgtcaagtcaaacggatgaatctcgacatctaaaccaaagtattgtgctgacccaaggctcacaagttatcgcgcccaaagcacttgttgatgaaaaccggctgtttgtgccgataagtggtgacagtattaatgagctaaaagcaaagctgtttcagctgcttagttcactagagattggcgcactaaacacgtcatttgcatcacatcaactcgcattctggtttgaacgctataatgccaacgcaccactggcattagtcttgatggcggcatctattgacgatctgaaacttgaagccaacgccatgcttgcggcgcttgaaaatgatgcggttcgtcatcagggtcaagcctttaagaccccagcgggcagctgttttaccgctaagccgctaggggatgcgggacttacctttgtatatcccggcgttggcacggtttacgccaatatgttcaataacttgcatgagtatttccccgcgctgtatcaccaactggagcgtgaaggcgatttaagcgccatgctgcaatcaccgctgatttatgcggcagatgttaaagccgcagcagacatgagcttaagccaacaagcgattagcggcgtgggcgccagttacctattcactaaattactcacccaagtttttaatattaagccaaaaatggcgctgggctactcaatgggcgaagccgccatgtgggccagtcttgatgtatggcaaacgccccatgctatgatcaacgccaccgaaaatagcgatattttcaatcatgccatttctggcgagctaaccgcagtgcgccgggcatggcagcttaaggataatgaagccatagtgtggaacagctttgtggtgcgcgctgatagccatgaaatcaaggcattattgccagcgtttcctcgcgcctacttagccatcacccaaggtgatacctgcgtcattgctggctgcgaaacaagctgcaaagccctgcttgccacgttaggtaaacgcggcattgccgctaatcgcgtcacggccatgcataccgcacccgccatgttagtccatggacaagtacaagatttctatacgcaagcgctaaaacctgaggtgctgaaacctaaggcgctggaagcggcagcacatggctcgctgattcgctttatcagtgcagcgcaaactgcgccagtggcagtggatagccacagcattggccgcgcgattgccgataccttttgttcgccactcgactttagtgcgctcattcaaaatgccaccgagcaaggcgcaaggctatttgtcgaagtgggcgccgataggcaaaccagcacgctcatcgataaaatcggccatgcccatgccggccaaagcactgcgaacgcggcgacagccgccattgcttgcaatgccaagggtgccgacgcgattaccagcttactcaagtgtttagctcagctgataagccacagagtgccgctgtcgctcgcgccgctcattcagccattaaatgctaacgcagcccctttatcatcagcagtatcaccacaaggagaaccccagtga

SEQ ID NO: 20 - protein, 672 aa, Shewanella hafniensis
  misc_feature: SGI Peptide ID NO. 1257566
  misc_feature: PfaB polypeptide
  misc_feature: Useful for modulating production of PUFA
  misc_feature (1)..(672): NCBI GI: 120599575 Blast Desc: omega-3 polyunsaturated fatty acid synthase PfaB [Shewanella sp. W3-18-1] gi|146292428|ref|YP_001182852.1| omega-3 polyunsaturated fatty acid synthase PfaB [Shewanella putrefaciens
  misc_feature (1)..(672): NCBI GI: 304409534 Blast Desc: PfaB family protein [Shewanella baltica OS183] gi|304352052|gb|EFM16450.1| PfaB family protein [Shewanella baltica OS183] gi|333819485|gb|AEG12151.1| PfaB family protein
  misc_feature (1)..(671): NCBI GI: 217974088 Blast Desc: PfaB family protein [Shewanella baltica OS223] gi|217499223|gb|ACK47416.1| PfaB family protein [Shewanella baltica OS223]
  misc_feature (1)..(672): NCBI GI: 319425729 Blast Desc: omega-3 polyunsaturated fatty acid synthase, PfaB [Shewanella putrefaciens 200]
  misc_feature (1)..(672): NCBI GI: 206570565 Blast Desc: PfaB [Shewanella sp. BR-2]
  misc_feature (1)..(672): NCBI GI: 334862820 Blast Desc: PfaB family protein [Shewanella baltica OS117]
  misc_feature (1)..(672): NCBI GI: 126173662 Blast Desc: PfaB family protein [Shewanella baltica OS155] gi|125996867|gb|ABN60942.1| omega-3 polyunsaturated fatty acid synthase PfaB [Shewanella baltica OS155]
  misc_feature (1)..(672): NCBI GI: 160874570 Blast Desc: PfaB family protein [Shewanella baltica OS195] gi|160860092|gb|ABX48626.1| PfaB family protein [Shewanella baltica OS195] gi|315266809|gb|ADT93662.1| PfaB family protein
  misc_feature (1)..(672): NCBI GI: 152999950 Blast Desc: PfaB family protein [Shewanella baltica OS185] gi|151364568|gb|ABS07568.1| PfaB family protein [Shewanella baltica OS185]
  misc_feature (2)..(672): NCBI GI: 336310879 Blast Desc: omega-3 polyunsaturated fatty acid synthase subunit, PfaB [Shewanella sp. HN-41] gi|335865559|gb|EGM70575.1| omega-3 polyunsaturated fatty acid synthase subunit, PfaB [Shewanella sp.
  misc_feature (293)..(601): Pfam Id: PF00698 Pfam Desc: Acyl transferase domain
MYEPRSLTVLLSQAVAAIEQGKLVELIFNDGNLPQSLYLLDGLIAAKLRLHAHAFIAGFAAGNGATGDVNAAVANAAAVANKALGAAKRNPAQTVQHQMVANTLNEACIALRQGVTALAARTQAPLYGKEGENQQTGYWFSDQHQARVLCLNFVAKTSSQTDESRHLNQSIVLTQGSQVIAPKALVDENRLFVPISGDSINELKAKLFQLLSSLEIGALNTSFASHQLAFWFERYNANAPLALVLMAASIDDLKLEANAMLAALENDAVRHQGQAFKTPAGSCFTAKPLGDAGLTFVYPGVGTVYANMFNNLHEYFPALYHQLEREGDLSAMLQSPLIYAADVKAAADMSLSQQAISGVGASYLFTKLLTQVFNIKPKMALGYSMGEAAMWASLDVWQTPHAMINATENSDIFNHAISGELTAVRRAWQLKDNEAIVWNSFVVRADSHEIKALLPAFPRAYLAITQGDTCVIAGCETSCKALLATLGKRGIAANRVTAMHTAPAMLVHGQVQDFYTQALKPEVLKPKALEAAAHGSLIRFISAAQTAPVAVDSHSIGRAIADTFCSPLDFSALIQNATEQGARLFVEVGADRQTSTLIDKIGHAHAGQSTANAATAAIACNAKGADAITSLLKCLAQLISHRVPLSLAPLIQPLNANAAPLSSAVSPQGEPQ

SEQ ID NO: 21 - DNA, 5907 bp, Shewanella hafniensis
  misc_feature: SGI cDNA ID NO. 1257567
  misc_feature: PfaC gene
  misc_feature: Encodes the peptide sequence at SEQ ID NO 22
  misc_feature: Useful for modulating production of PUFA
atgactgcgtcaaactatgcgtcaaatcacgcatcaaacagtgcgccaaaaattgcgatcgttggtctcgcgactcagtatcccgacgccgataatccgcaaaccttctggcaaaatctgctggataaaaaagactctcgcagccaaattagccgcgaaaagctcaatgctaatcccgccgattaccaaggtgtgcaaggtcagtctgatcgcttttactgcgataaaggcggctacattcaacactttgagtttgatgccaagggttatcaactgcctgagtccgcctttgatggtttagatgaaagctttttatgggcactcgattgcagtcgtaaagccctgcaagatgcagggattgccgcaagcgatgccgtactggcgcgcacaggtattgtaatgggcaccttgtcgttccccaccgcccgctcccacgaactgtttttgcccttgtatcaccaaaccgttgaaaaggcgctgcaaaataaactgaatcaaagcgcgtttcagctgactgattttggcaactcagttaacgacctcaatgccaatagccaagcattaaacatcgccaatggcgcggttgcccacacagcctcaaaactggtcagcgatgcactcggtttaggtggcactcagttgagtctggacgccgcctgcgccagctcggtttatgcgctcaaactcgcctgcgattacctaaccacaggcaaggccgatgtgatgcttgcgggcgccgtatcgggcgccgatcctttctttatcaacatgggattctcgattttccacgcctatccagatcacggtatttcggcgccctttgatagcaacagtaaaggcttgttcgctggcgaaggcgctggggtgttagtgttaaaacgcttggaggatgcgcagcgcgatggcgacaacatctatgccgtcgtcagcggcattggtttgtcgaacgacggtaaaggccagtttgtattaagccccaacagcaagggccaagtgcaagccttcgagcgcgcctacagtgccgcaaatacactgcccgccaatatcgaagtgattgaatgccacgctacgggcacgccacttggggataaggtcgaactcgcctcgatggagcgcttttttgaggacaaactcgcgggctcagctgtgccgcttatcggctcggcaaaatccaacttaggccatttactcacggccgcaggcatgccggggatcatgaagatgatttttgccatgcgctcgggccgcttgccgcccagtataaatttatcggcgccgatatcctcacctaagggcttatttagcgctaaaaacctcccgacagaaatgcacgcgtggcccgataaagctggcaatgaccgccgccatgcgggcgtttctgtgtttggttttggcggctgtaacgcgcatttgttgctggaatcctatgcaccgacaaataacagtagccagcatacccagagtgcagctcaagtcagttatcagcacacgccgttaactatcattggcttagcatcgcacttcgggcctttatcatcgattaatgcactggataacgcgatttgctctcagcaaaacgccttcattccactgcccgctaaacgctggaaaggcttagataaacatcctgacatcttagctaactttggcttaccagctgtaccgcaaggcgcctatatcgaccagttcaattttgacttcctgcgctttaaagtgccgcccaatgaggatgatcgcctgatctcccagcaactgctgctgatcaaagtggccgatgaagcgatccgcgacgctaaccttaagccaggtggcaaggtggccgtattagtggcgatggaaacagagcttgaattacaccagttccgtggccgagtgaatctgcacactcaactggcagatagtcttaaaaaacaagggatcaccctcacgcaagctgagtatctcgcccttgaaaaaatcgccatggacagtgtgctcgatgccgccaaactgaaccaatacaccagttttattggcaacatcatggcgtcacgtatcgcatccctttgggactttaacggccctgcttttaccatttcggcggccgagctttcagtcgcccgctgtatcgatgtggccgaaaacctgttatcccaagaatccttagatgccgtagtgatcgccgccgtcgatttaagtggcagtctcgagcaagtggtgcttaaaaacgccgtatcgcctgtggcattaaatgccacagacattggctggaaagtcggtgaaggtgccggcgcgctggtgctcactgctgaaaattcaaatacgaatgctcaacttaatgatgccaatagcaacaactttggcaacagctatggtcacattagcggccaagtgtttggcgctgtatatgacccccaaggcaacagcaacacagcgcgaatttgcgataacttgttaactcaagccaaagtgagtagcagccagattagcttgattgaaaccagtattgcggttgagcaacgaagcgagccagctctggcacccaataccctgttgccaagtgtgagtgagcgcagccaagccgcaaacaccttaggccacaactttgctgcggcgggaatggcgagtatcttgagcgccctacttcagttaaaaaatcaagttcagcttaaaaaccaagcgcagcacgcgctcgttgccacctttagtcaaggtaagtgcgcgcagttattgctcagccaaagtgctatgcaggcgcaaagtttgcagcaaagactcgcgcaagacttaacgctttctgagcaaaaacacttgataaaacaagtgacactcggaggccgcgatatctatcagcatatcctggataccccgctcgcagaccttggtgcaatacaacaaaaagcccaagccatgacggcattgccagcgcgcagccaacgcaagcatttggcccaaatagcgagcaaagacactaatcgcgttgcaacaagcggcccgaatacggctcaacaagaagagacattaagcagcatgccaataaatgccctaagcacgcccaacaacactgccgctcacgcagatctaaaagacgcggcatttttacgtaatcagcaactcacccgtgaagcccatttagcctttttacaaagccgtgctgaaggcttaaaactggccgatgccttgatgaaagcccagcttgccagcgagttagccgttaatggccaagctgcgcaagcggagcagcaagccattgttcaggcatctgcgacagcggttcttccacatactgcactttatccaaaccaagtgctttatccaaaccatgcaaaagtgcctgagtacacgccgccaacgccgataagcaaaccttgtatttgggattatgcggatttggtcgagtacgccgaaggggatatcgctaaggtctttggcccagattacaccattattgacagctattcgcgccgtgtacgcctgccaaccacggactatttgctggtgtctcgggtaacgaaattaaacgcccagatgaaccgatatgagccttgcactatgaccacggaatacgatattcctgtggacgcgccgtatctggtcgatggtcaaatcccctgggccgtggcggtcgaatcgggtcaatgcgatttgatgctgatcagctacttaggtatcgactttgaaaacaagggcgagcgcgtttatcgcctgctcgattgcactctgaccttccttggtgacttaccccgcggtggcgacactttgcgctacgatatttccatcaacaagtttgcccgtaatggcgataccttgttgttcttcttctcctacgaatgtttcgtgggcgataagctgatcctgaaaatggatgacggctgcgccggcttcttcaccgacaaggaactcgccgacggcaagggcgttattcgcaccgaagccgaaatcaaagcccgtaaccttgcgctcaataatcccaataaaccgcgctttaatccgctgcttaactgcgcgcaaaaccaatttgattacagccaaatccataaattactcggcgccgatatcggtggctgttttggcggcgcccatgcggcgcatcaagcccaatatgggttgcagccctctttatgttttgcctctgaaaaattcctgatgattgaacaagtcagcaatcttgaggtgcatggcggtgcgtggggcttaggctcagtgcaaggccataagcagctcgaagctgatcattggtatttcccgtgtcatttcaagggcgaccaagtgatggcggggtcattaatggccgaaggttgtggtcaattactgcaattctttatgctgcacattggaatgcacgccagtacagaagaagggggcgtcaaaaatggtcgtttccaaccgctcgaaaatgcctctcaaaaagtgcgctgtcgcggtcaagttttgccgcaatctggcctgctcacctatcgcatggaaatcaccgaaatcggtatgagtccacgcccgtatgcgaaggcgaatatcgatattctgctcaatggcaaagtggtggtggacttccaaaaccttggagtcatgatcaaagaagaagccgaatgcactcgctaccttgcggataacgatgccagcacagccaataagaatgcgccgcttacctcgacaacaccaatatccttagcggcgccgctaatggcccagcagcccgatttaactgcgccaaccaataaaggcgtagtgccgcttaagcatgtgagcgcacccgtcgcgccagcggattcaaagtacgctaaccgcgtgcccgataccctgccgttcacgccgtaccacatgttcgaatttgccacgggcgacatcgaaaactgcttcggccctgatttcagtatctatcgcggcctaattccaccgcgcacgccctgcggtgatttacagctcacgactcgcgtcattgcgattgacggcaaacgcggcgagctgaaaaagccgtcatcgtgcatcgccgaatacgaagtgccagcaaatgcttggtattacactaaaaacagccatcacgccgtaatgccctattcagtgctgatggaaatatcactgcagccaaatggctttatctcaggctatatgggcaccaccttgggcttccccggccaagagctgtttttccgtaacttggacggtagcggtaagttgctgcgtcacgtggatttacgcggcaaaaccatagtgaacgactcacgtttgttatcgactgtgattgccggcagtaacatcatccagaatttcagcttcgagctaagctgcgatggcgagccgttctaccaaggtaaagcggtatttggttacttcaagggcgatgcgctgaaaaaccagttaggcatagacaacggcaagaccactcagccttggcatgtgcaaaatggcatagcggccgatagccaaatcaatctgttagataaacaacatcgcagctttaacgcaccacaaggtcagccacattaccgtttagcgggcggtcagcttaactttatcgacaaggctgaaatcgtgaaagctggcggtaaagcgggccttggctatttatacgccgagcgcaccattgacccgagtgattggttcttccaattccacttccatcaagatccggtaatgccaggctcattaggggttgaagccattatcgagctgatgcaaacctatgcgattgaccaagaccttggtgcgggctttaaaaatccaaaatttggccagatattgtcggatatcaaatggaagtatcgcggccaaattaacccattaaacaagcagatgtcgctggatgttcacattaccagcgtgacagacgacaatggtaaacgcatcattatgggcgatgccaacttaattaaagatggcctacggatttatgaagttaaagatatcgccatctgtattgaagaagcttaa

SEQ ID NO: 22 - protein, 1968 aa, Shewanella hafniensis
  misc_feature: SGI Peptide ID NO. 1257567
  misc_feature: PfaC polypeptide
  misc_feature: PfaC polypeptide
  misc_feature: Useful for modulating production of PUFA
  misc_feature (1)..(1968): NCBI GI: 319425728 Blast Desc: multi-domain beta-ketoacyl synthase, PfaC [Shewanella putrefaciens 200]
  misc_feature (2)..(1968): NCBI GI: 120599576 Blast Desc: Beta-hydroxyacyl-(acyl-carrier-protein) dehydratase, FabA/FabZ [Shewanella sp. W3-18-1] gi|146292427|ref|YP_001182851.1| dehydratase, FabA/FabZ CN-32]
  misc_feature (2)..(1968): NCBI GI: 160874569 Blast Desc: beta-hydroxyacyl-(acyl-carrier-protein) dehydratase FabA/FabZ [Shewanella baltica OS195] gi|160860091|gb|ABX48625.1| Beta-hydroxyacyl-(acyl-carrier-protein) dehydratase FabA/FabZ
  misc_feature (11)..(1968): NCBI GI: 126173661 Blast Desc: Beta-hydroxyacyl-(acyl-carrier-protein) dehydratase FabA/FabZ [Shewanella baltica OS155] gi|125996866|gb|ABN60941.1| Beta-hydroxyacyl-(acyl-carrier-protein) dehydratase, FabA/FabZ
  misc_feature (17)..(298): Pfam Id: PF00109 Pfam Desc: Beta-ketoacyl synthase, N-terminal domain
  misc_feature (18)..(1486): NCBI GI: 290475945 Blast Desc: 3-oxoacyl-[acyl-carrier-protein] synthase [Xenorhabdus bovienii SS-2004] gi|289175273|emb|CBJ82076.1| 3-oxoacyl-[acyl-carrier-protein] synthase [Xenorhabdus bovienii
  misc_feature (306)..(423): Pfam Id: PF02801 Pfam Desc: Beta-ketoacyl synthase, C-terminal domain
  misc_feature (498)..(764): Pfam Id: PF00109 Pfam Desc: Beta-ketoacyl synthase, N-terminal domain
  misc_feature (1040)..(1965): NCBI GI: 166365528 Blast Desc: short-chain dehydrogenase/reductase [Microcystis aeruginosa NIES-843] gi|166087901|dbj|BAG02609.1| short-chain dehydrogenase/reductase [Microcystis aeruginosa NIES-843]
  misc_feature (1089)..(1968): NCBI GI: 75910946 Blast Desc: beta-ketoacyl synthase [Anabaena variabilis ATCC 29413] gi|75704671|gb|ABA24347.1| Beta-ketoacyl synthase [Anabaena variabilis ATCC 29413]
  misc_feature (1100)..(1968): NCBI GI: 332293044 Blast Desc: PfaB family protein [Krokinobacter diaphorus 4H-3-7-5] gi|332171130|gb|AEE20385.1| PfaB family protein [Krokinobacter sp. 4H-3-7-5]
  misc_feature (1100)..(1968): NCBI GI: 91218438 Blast Desc: glycolipid synthase [Psychroflexus torquis ATCC 700755] gi|91183429|gb|EAS69830.1| glycolipid synthase [Psychroflexus torquis ATCC 700755]
  misc_feature (1106)..(1968): NCBI GI: 17229135 Blast Desc: all1643 [Nostoc sp. PCC 7120] gi|17135463|dbj|BAB78009.1| all1643 [Nostoc sp. PCC 7120]
  misc_feature (1371)..(1510): Pfam Id: PF07977 Pfam Desc: FabA-like domain
  misc_feature (1826)..(1959): Pfam Id: PF07977 Pfam Desc: FabA-like domain
MTASNYASNHASNSAPKIAIVGLATQYPDADNPQTFWQNLLDKKDSRSQISREKLNANPADYQGVQGQSDRFYCDKGGYIQHFEFDAKGYQLPESAFDGLDESFLWALDCSRKALQDAGIAASDAVLARTGIVMGTLSFPTARSHELFLPLYHQTVEKALQNKLNQSAFQLTDFGNSVNDLNANSQALNIANGAVAHTASKLVSDALGLGGTQLSLDAACASSVYALKLACDYLTTGKADVMLAGAVSGADPFFINMGFSIFHAYPDHGISAPFDSNSKGLFAGEGAGVLVLKRLEDAQRDGDNIYAVVSGIGLSNDGKGQFVLSPNSKGQVQAFERAYSAANTLPANIEVIECHATGTPLGDKVELASMERFFEDKLAGSAVPLIGSAKSNLGHLLTAAGMPGIMKMIFAMRSGRLPPSINLSAPISSPKGLFSAKNLPTEMHAWPDKAGNDRRHAGVSVFGFGGCNAHLLLESYAPTNNSSQHTQSAAQVSYQHTPLTIIGLASHFGPLSSINALDNAICSQQNAFIPLPAKRWKGLDKHPDILANFGLPAVPQGAYIDQFNFDFLRFKVPPNEDDRLISQQLLLIKVADEAIRDANLKPGGKVAVLVAMETELELHQFRGRVNLHTQLADSLKKQGITLTQAEYLALEKIAMDSVLDAAKLNQYTSFIGNIMASRIASLWDFNGPAFTISAAELSVARCIDVAENLLSQESLDAVVIAAVDLSGSLEQVVLKNAVSPVALNATDIGWKVGEGAGALVLTAENSNTNAQLNDANSNNFGNSYGHISGQVFGAVYDPQGNSNTARICDNLLTQAKVSSSQISLIETSIAVEQRSEPALAPNTLLPSVSERSQAANTLGHNFAAAGMASILSALLQLKNQVQLKNQAQHALVATFSQGKCAQLLLSQSAMQAQSLQQRLAQDLTLSEQKHLIKQVTLGGRDIYQHILDTPLADLGAIQQKAQAMTALPARSQRKHLAQIASKDTNRVATSGPNTAQQEETLSSMPINALSTPNNTAAHADLKDAAFLRNQQLTREAHLAFLQSRAEGLKLADALMKAQLASELAVNGQAAQAEQQAIVQASATAVLPHTALYPNQVLYPNHAKVPEYTPPTPISKPCIWDYADLVEYAEGDIAKVFGPDYTIIDSYSRRVRLPTTDYLLVSRVTKLNAQMNRYEPCTMTTEYDIPVDAPYLVDGQIPWAVAVESGQCDLMLISYLGIDFENKGERVYRLLDCTLTFLGDLPRGGDTLRYDISINKFARNGDTLLFFFSYECFVGDKLILKMDDGCAGFFTDKELADGKGVIRTEAEIKARNLALNNPNKPRFNPLLNCAQNQFDYSQIHKLLGADIGGCFGGAHAAHQAQYGLQPSLCFASEKFLMIEQVSNLEVHGGAWGLGSVQGHKQLEADHWYFPCHFKGDQVMAGSLMAEGCGQLLQFFMLHIGMHASTEEGGVKNGRFQPLENASQKVRCRGQVLPQSGLLTYRMEITEIGMSPRPYAKANIDILLNGKVVVDFQNLGVMIKEEAECTRYLADNDASTANKNAPLTSTTPISLAAPLMAQQPDLTAPTNKGVVPLKHVSAPVAPADSKYANRVPDTLPFTPYHMFEFATGDIENCFGPDFSIYRGLIPPRTPCGDLQLTTRVIAIDGKRGELKKPSSCIAEYEVPANAWYYTKNSHHAVMPYSVLMEISLQPNGFISGYMGTTLGFPGQELFFRNLDGSGKLLRHVDLRGKTIVNDSRLLSTVIAGSNIIQNFSFELSCDGEPFYQGKAVFGYFKGDALKNQLGIDNGKTTQPWHVQNGIAADSQINLLDKQHRSFNAPQGQPHYRLAGGQLNFIDKAEIVKAGGKAGLGYLYAERTIDPSDWFFQFHFHQDPVMPGSLGVEAIIELMQTYAIDQDLGAGFKNPKFGQILSDIKWKYRGQINPLNKQMSLDVHITSVTDDNGKRIIMGDANLIKDGLRIYEVKDIAICIEEA

SEQ ID NO: 23 - DNA, 1647 bp, Shewanella hafniensis
  misc_feature: SGI cDNA ID NO. 1257568
  misc_feature: PfaD gene
  misc_feature: Encodes the peptide sequence at SEQ ID NO 24
  misc_feature: Useful for modulating production of PUFA
atgacaagccatactctcgatcaatttaatagtaataacgaaaaactcagcccttggccgtggcaagtcaatgatgcagcactgagctttgatatcgactcattaggcaaaaaactcaaagatttaagccaagcctgctacttagtcaatcacagtgaaaaaggcttaggcatagcgcaaacggctgaagtgaccaccagtgacagccaagcgccattgggctcacaccccgtcagcgcctttgcgcccgcccttggcacccaaagtttaggcgacagtaattttcgccgcgtacacggggttaaatacgcttactacgctggcgctatggccaacggtattgcctcggaagaactggttatcgcccttggtcaagcgggcattttgtgctcatttggcgcggcggggttaattccatcgagggttgaggcggccatcaaacgtattcaaacggcgctgcccaatggtccctacgcctttaacttgatccacagcccaagcgagcccgcattagagcgcggcagtgttgagctgtttttaaaacataaagtgcgcacggtcgaagcctcggcatttttaggcttaacgccgcaaatcgtctattaccgcgcggcgggtttgagccgcgacgaacatggcgacatcgtcattggcaacaaagtcatcgctaaaatcagccgcaccgaagtcgcaactaagtttatggagccagcgcctgccaaaatcctcctgcaattagtgagtgatggtcttatcagccaagaccaaatggcaatggcattactggtgccaatggcggacgacatcacggccgaagccgactcaggtggccataccgacaatcgtccattggtcacgctattgccgacgattttggcgctcaaagatgaaatccaagctaagtatcaatacaagacacccatccgtgtgggagcaggcggcggcgttggtacgcccgatgcggcactcgccaccttcaacatgggcgcggcgtttattgtcacaggttcaatcaaccaagcgtgtgtggaggcgggcgccagcgaacacacccgtaagttactcgccaccacagaaatggccgatgtgactatggcgcctgccgccgatatgttcgaaatgggcgtgaaattacaagtggttaagcgcggcactctgttccctatgcgcgccaataagctatatgaaatctatactcgttacgattcgattgatgccatccctgcggacgagcgtaaaaagctcgaagagcaggtattccgcgcatcactcgatgatatttgggcgggcacagttgcccactttaacgagcgcgaccctaagcaaatcgaacgtgcgctggataaccccaaacgtaagatggcgttgattttccgctggtatttgggtctgtctagccgctggtcgaacacaggtgaagtcggccgcgaaatggattaccaaatttgggcaggcccagcgctcggcgcatttaatgcttgggcaaaaggcagttatttagatgactataaagcccgtaatgcggtcgatttagccaaacatttaatggtgggagcggcctatcaatcccggattaacttgctgttatcccaaggggttagcattccatttagcctgcaacgctggaaaccgctaaatcgtttttaa

SEQ ID NO: 24 - protein, 548 aa, Shewanella hafniensis
  misc_feature: SGI Peptide ID NO. 1257568
  misc_feature: PfaD polypeptide
  misc_feature: Useful for modulating production of PUFA
  misc_feature (1)..(548): NCBI GI: 120599577 Blast Desc: 2-nitropropane dioxygenase, NPD [Shewanella sp. W3-18-1] gi|146292426|ref|YP_001182850.1| 2-nitropropane dioxygenase, NPD [Shewanella putrefaciens CN-32] 2-nitropropane
  misc_feature (1)..(548): NCBI GI: 152999948 Blast Desc: PfaD family protein [Shewanella baltica OS185] gi|160874568|ref|YP_001553884.1| PfaD family protein [Shewanella baltica OS195] gi|151364566|gb|ABS07566.1| PfaD family protein
  misc_feature (1)..(548): NCBI GI: 319425727 Blast Desc: omega-3 polyunsaturated fatty acid synthase subunit, PfaD [Shewanella putrefaciens 200]
  misc_feature (1)..(548): NCBI GI: 126173660 Blast Desc: PfaD family protein [Shewanella baltica OS155] gi|125996865|gb|ABN60940.1| 2-nitropropane dioxygenase, NPD [Shewanella baltica OS155] gi|334862818|gb|AEH13289.1| PfaD
  misc_feature (1)..(548): NCBI GI: 304409532 Blast Desc: PfaD family protein [Shewanella baltica OS183] gi|304352050|gb|EFM16448.1| PfaD family protein [Shewanella baltica OS183] gi|333819487|gb|AEG12153.1| PfaD family protein
  misc_feature (1)..(548): NCBI GI: 217974090 Blast Desc: PfaD family protein [Shewanella baltica OS223] gi|217499225|gb|ACK47418.1| PfaD family protein [Shewanella baltica OS223]
  misc_feature (1)..(547): NCBI GI: 336310877 Blast Desc: enoyl-[acyl-carrier-protein] reductase [FMN] , inferred for PFA pathway [Shewanella sp. HN-41] gi|335865557|gb|EGM70573.1| enoyl-[acyl-carrier-protein] [FMN] ,
  misc_feature (1)..(547): NCBI GI: 114048228 Blast Desc: 2-nitropropane dioxygenase, NPD [Shewanella sp. MR-7] gi|113889670|gb|ABI43721.1| 2-nitropropane dioxygenase, NPD [Shewanella sp. MR-7]
  misc_feature (1)..(547): NCBI GI: 117921284 Blast Desc: 2-nitropropane dioxygenase, NPD [Shewanella sp. ANA-3] gi|117613616|gb|ABK49070.1| 2-nitropropane dioxygenase, NPD [Shewanella sp. ANA-3]
  misc_feature (1)..(547): NCBI GI: 24373167 Blast Desc: SO_1597 [Shewanella oneidensis MR-1] gi|24347375|gb|AAN54654.1|AE015605_3 conserved [Shewanella oneidensis MR-1]
  misc_feature (87)..(524): PfaD family protein
  misc_feature (95)..(370): Pfam Id: PF03060 Pfam Desc: Nitronate monooxygenase / enoyl reductase
MTSHTLDQFNSNNEKLSPWPWQVNDAALSFDIDSLGKKLKDLSQACYLVNHSEKGLGIAQTAEVTTSDSQAPLGSHPVSAFAPALGTQSLGDSNFRRVHGVKYAYYAGAMANGIASEELVIALGQAGILCSFGAAGLIPSRVEAAIKRIQTALPNGPYAFNLIHSPSEPALERGSVELFLKHKVRTVEASAFLGLTPQIVYYRAAGLSRDEHGDIVIGNKVIAKISRTEVATKFMEPAPAKILLQLVSDGLISQDQMAMALLVPMADDITAEADSGGHTDNRPLVTLLPTILALKDEIQAKYQYKTPIRVGAGGGVGTPDAALATFNMGAAFIVTGSINQACVEAGASEHTRKLLATTEMADVTMAPAADMFEMGVKLQVVKRGTLFPMRANKLYEIYTRYDSIDAIPADERKKLEEQVFRASLDDIWAGTVAHFNERDPKQIERALDNPKRKMALIFRWYLGLSSRWSNTGEVGREMDYQIWAGPALGAFNAWAKGSYLDDYKARNAVDLAKHLMVGAAYQSRINLLLSQGVSIPFSLQRWKPLNRF

SEQ ID NO: 25 - DNA, 987 bp, Shewanella hafniensis
  misc_feature: SGI cDNA ID NO. 1257570
  misc_feature: Encodes the peptide sequence at SEQ ID NO 26
  misc_feature: Useful for modulating production of PUFA
atgaatcctgaacagaatgctgctaagtgctctccagaaagccagccaatgataactcatcagccgcagggctttgtacagcttggctctcgaatgactgattctctagcatctagcaaaaatggcgtgaatgtggatctattttttattccgctgcatgatatttcagtggccaaaacattactcgccgagtcttggttaagtgaggatgaactggcaaaggttgcgcgttatcgcgaccccaaggcgcaaatgaagggattacaggtcagggcggcgctgcgggccgtgttatctcactatgcggatttatcgccacaggcgtggtgtttcgaatatggcgctaagggtaaaccgagcttaacgacggcattacggcagcaaactgggcttgagtttaacctaagccatagcggcgattggttattgattggtgtggctcagtttcatggcgttgagtctggtttatttggggtcgatattgaaagatcgcggccgaagacggatatctatccaatcctaaatcattatttttctccccaagaaacgtcagccttgctcgctctcgccgatgaagcgagccagcggcagcgctttttcgatttatgggcgttaaaggagtcctatatcaaggccacaggactcggtttagcgcagtcgcttaaatctttcgcctttgagctaaagccgttcgaacaactggcagtcgaatcgcttgagctatcctgtcaagatgccgcattaaggcaatcctgcggcgtagcagagaggcttaatgtttatccacatatttcattacaagtcccgctacaaattccaatacacacactggatttagcagaccctatgcattggcaggcacattttggtcgtttgaccgaggagtatcgctttgccattagcctagcgcatgccggtaacgccagtcttcctttaacgctaaccgcacagctgagcagtatagagtgcttacttgttgctgattaa

SEQ ID NO: 26 - protein, 328 aa, Shewanella hafniensis
  misc_feature: SGI Peptide ID NO. 1257570
  misc_feature: PfaE polypeptide
  misc_feature: Useful for modulating production of PUFA
  misc_feature (1)..(325): NCBI GI: 217974085 Blast Desc: 4'-phosphopantetheinyl transferase [Shewanella baltica OS223] gi|217499220|gb|ACK47413.1| 4'-phosphopantetheinyl transferase [Shewanella baltica OS223]
  misc_feature (1)..(325): NCBI GI: 160874573 Blast Desc: 4'-phosphopantetheinyl transferase [Shewanella baltica OS195] gi|160860095|gb|ABX48629.1| 4'-phosphopantetheinyl transferase [Shewanella baltica OS195] 4'-phosphopantetheinyl
  misc_feature (1)..(325): NCBI GI: 152999953 Blast Desc: 4'-phosphopantetheinyl transferase [Shewanella baltica OS185] gi|151364571|gb|ABS07571.1| 4'-phosphopantetheinyl transferase [Shewanella baltica OS185]
  misc_feature (32)..(325): NCBI GI: 206570562 Blast Desc: 4'-phosphopantetheinyl transferase [Shewanella sp. BR-2]
  misc_feature (32)..(325): NCBI GI: 126173665 Blast Desc: 4'-phosphopantetheinyl transferase [Shewanella baltica OS155] gi|125996870|gb|ABN60945.1| 4'-phosphopantetheinyl transferase [Shewanella baltica OS155] 4'-phosphopantetheinyl
  misc_feature (32)..(325): NCBI GI: 304409537 Blast Desc: 4'-phosphopantetheinyl transferase [Shewanella baltica OS183] gi|304352055|gb|EFM16453.1| 4'-phosphopantetheinyl transferase [Shewanella baltica OS183] 4'-phosphopantetheinyl
  misc_feature (43)..(325): NCBI GI: 120599572 Blast Desc: 4'-phosphopantetheinyl transferase [Shewanella sp. W3-18-1] gi|120559665|gb|ABM25592.1| 4'-phosphopantetheinyl transferase [Shewanella sp. W3-18-1]
  misc_feature (43)..(325): NCBI GI: 319425732 Blast Desc: 4-prime-phosphopantetheinyl transferase, PfaE [Shewanella putrefaciens 200]
  misc_feature (43)..(325): NCBI GI: 146292431 Blast Desc: 4'-phosphopantetheinyl transferase [Shewanella putrefaciens CN-32] gi|145564121|gb|ABP75056.1| 4'-phosphopantetheinyl transferase [Shewanella putrefaciens
  misc_feature (45)..(325): NCBI GI: 336310882 Blast Desc: 4'-phosphopantetheinyl transferase , inferred for PFA pathway [Shewanella sp. HN-41] gi|335865562|gb|EGM70578.1| 4'-phosphopantetheinyl transferase , inferred for PFA pathway sp.
  misc_feature (158)..(222): Pfam Id: PF01648 Pfam Desc: 4'-phosphopantetheinyl transferase superfamily
MNPEQNAAKCSPESQPMITHQPQGFVQLGSRMTDSLASSKNGVNVDLFFIPLHDISVAKTLLAESWLSEDELAKVARYRDPKAQMKGLQVRAALRAVLSHYADLSPQAWCFEYGAKGKPSLTTALRQQTGLEFNLSHSGDWLLIGVAQFHGVESGLFGVDIERSRPKTDIYPILNHYFSPQETSALLALADEASQRQRFFDLWALKESYIKATGLGLAQSLKSFAFELKPFEQLAVESLELSCQDAALRQSCGVAERLNVYPHISLQVPLQIPIHTLDLADPMHWQAHFGRLTEEYRFAISLAHAGNASLPLTLTAQLSSIECLLVAD

SEQ ID NO: 27 - DNA, 8049 bp, Pseudoalteromonas sp.
  misc_feature: SGI cDNA ID NO. 277634F
  misc_feature: PfaA gene
  misc_feature: Encodes the peptide sequence at SEQ ID NO 28
  misc_feature: Useful for modulating production of PUFA
atgtcgaataaaagtcaggcaaaacctgctttagcaaaaacggttaaagacgttgatgcattagttgatgaacaacaatttaattcccgtttacaagaatgcccaattgccattgttggcatggcatcagtgtttgctgatgcaacaaatttagatcagtactgggataatatctttgagtctgttgattcaataagagatgtccctgcagatcgttgggcaattgacgattattactctgaagataaatttgcggcagataaaacatactgtaaacgcggtggttttttacctgagattgactttgatccgatggagtttggtcttccgccaaatattttagaattaacagatattgctcaattattatcattagttgttgcacgtgatgtattaaatgatgctggaataggtgaaggttctggttatgatcgcgataaagtgggtatcactttaggtgtaggtggtggtcaaaagcaaatatcacctttgacttcacgattacaaggtccagtacttgaaaaggtattaaaggcctcaggcgttgatgctgaagatcgtgcgatgatcattgagaagtttaaaaaagcgtatatcggttgggaagaaaattcattcccaggtatgttaggcaatgtaatttcaggtcgtattgcgaatcgctttgattttggtggcactaactgtgttgttgatgctgcatgtgctggctctttagccgctgttaaattagctatttcagatttattagaacatagatcagaagtgatgatctcaggtggtgtatgttgtgataactcaccattcatgtacatgtcattctctaaaacacctgcattcacaactaatgatgacattcgcccatttgacgatgattcaaaaggcatgatgataggtgaaggtatcggcatgatggcgtttaaacgtcttgaagatgcagaacgtgatggcgataaagtttatgctgtacttaaaggtattggtacatcttcagatggtcgttttaagtctatttatgcacctcgcccagacggtcaagctaaagcattaaaacgtgcatatgaagatgcaggatgggatccaaaaacatgtggtttaattgaagcccatggtacaggtactaaagcgggtgatgccgctgagtttgctggattaactaaacattttggtgctgataatgataaaacgcagcatattgcgttaggttcagtcaaatcacaagtcggccatactaaagctgctgcaggttctgcgggtatgatcaaagctgttcttgcactacatcataaagtattgcctggcacattacatattgatcaaccaaatactaacttagatattgaaaacagcccactatatttaaatagccaaactagaccttggatgccaagagaagatggtttacctcgtagagcgggtgtaagctcgtttggttttggtggtactaactaccatatggtactggaagagtaccagcctaaagccgaaggtgaataccgtattacggcagttccacagtctattttactgactgctgaaaatgaagctggcattgttgcacaattaaatgaccatttaacacaattatcagttgatgcagatgcacgagtttttgcatttaatcgtttagttacgcaaagtgttgctaccaagccagctacagaattagcccgttgtggttttattgcaaaaaatgctagccaagcaattgatatgatcaacgcagcgctaaaacaatttaaagcaaaagcaggtgatgtacagtggtcagtaccaacaggcatttactatcgccaatcaggtattgatgctaagggtaaagtggttgcattattctcaggccaaggctcacagtatgtgaatatgggtaatgaattagcatgtaacttcccaagtgtgatgcaaagtgctgcagatatggatgcacaatttgcatcggctggtttgtctcatttatcaaatgtgacttacccaattcctgtatttaatgatgcagatcgtaaagcacaagatgaagcattacgtctaacacaacatgcacaacctgcaattggctgttttagtgttggtttatataatacatttaaacaagcaggttttgcggcagatttcactgcaggtcatagttttggtgagttaacagctttgtgggctgctggcgtattaaatgataatgactacatgatgttagcacgtagtcgtggacaagcgatggctgcacctgaagatgaaaactttgatgcaggtactatgatcgcggttgtaggcgacccagtaaaagtatctgatgatattaaagacataaaagatatctcaattgccaattacaattcaaataatcaagttgttgtagccggtgtcactaaccaaattgaaatcgcaatgggcgaactaaaagcgaaaggttataaagtagtacctttaccagtttctgctgcatttcatacgccgcttgttggccatgcacaaaaaccatttgctaaagcaattgatagcgctaaattcacgaaaccgagtattcctgtatttgctaatggcacaggtaaagcgcatccaaataaagccgctgagattaaaaagagcttaaaaaaccatattttagaatcagttcattttaatgacgaaattgataatttatatgatgcgggtggtcgtatctttatcgagtttggccctaaaaatgtattaactaagctagttgaaaatattttgactgaaaagtctgatgtaacggcaattgccattaatgctaatcctaaaaaatctgcagatttacaaatgcgccaagctgcaatgcagatgttggtattaggtgtagatctaaatgaaattgacccatactcagccataaaacgcccattagaagccgctaaaaaatctcctttagcaatgaagttaacgggggcatcttacgtaagtcctaaaactaaaaaagcatttgatgatgcattaactgatggttggacaatcaagcaagctaaagcacaaccagtttcagtaccacaacctaaagttgtcgaaaaaatagtagaaaagattgttgaagtagaaaaagtagttgaaaaaatcgtttatgtacaagccgatggtagtcatacaaacacaccaaatgcagcagctacagcaacaaatgcagatgaattagcgtcaaatattgagcgcagtgtaggtcagtttgttgagcaccaacagcaattattaaatgtgcatgaacaatatatgcaaggcccacaagagtatgcaaaaactttccaaagtgtgcttgaagcacaaacaggtaacgagttacctgaaagcttagaccgtactttaggtatgtaccatgagttccaatcagaaacattacgtgttcatgagcaatatctaaataatcaaactgacaatatgtcagcaatgctaaatgatgtacaagaagcaccaagtgtttcagtagatactaaacaaacagtaacaaaggctcctgttgtaaaagcagctgtgccagtggctgctaaatcagtaccagttaagccagtaacagaagttaaaacacctgttactccagcaccagttaaaacagcagcaaaaagtattacgccagtacaaacagctgccacagcggttgctattgcaccagaagttgtaacagctgctccagtagttaaacctcaagttgaaactgttgctgcatttgatttaaataaagtaaacacagttatgcttgaagtggtagccgataaaacgggttacccagctgaaatgttagaacttgaaatggatatggaagccgatttaggtattgactctattaaacgtgttgagatcttaggttcagttcaagaaatgatccctgatttaccagacttaaatcctgaagacttagctgaattacgtacattaggtgaaatcgttgactatatgaagtcaaaagcacaagctgcgacaccaactaatgtatcaagtgcacctgcattacatttagttgaaacagactcagtacctagcattgatttaaaccacatccaatctgtgatgatggaagtggtagcagataaaacaggttaccctgttgaaatgttagagcttgaaatggatatggaagctgatttaggcatagattctatcaaacgtgttgaaatcttaggttcagtacaagagacaattgctgacttaccagacttaaaccctgaagatttagctgaactacgtactttaggtgaaatcgtttcttacatgcagtctaaagtatcagctgcacctgtaactacatcagaagttgtttcagcaggagttacgcaagtagcacctagcattgacttaaaccacatccaatcagtaatgatggcagtggtagcagaaaaaacaggttaccctgtggaaatgctagagcttgaaatggatatggaagctgacttaggcatcgactcaattaaacgtgttgaaatcttaggttcagtacaagagacaattacagacttaccagatttaaatccagaagatttagcagagcttcgtactttaggtgaaatcgtttcatacatgcagtctaaagtatcagttgcacctacagctgttgtttctgcaccagtcgaacaagctgcacctagcattgatttaaaccacatccaatcagtaatgatgacagtggtagcagagaaaacaggctatcctgttgaaatgctagagcttgaaatggatatggaagctgatttaggtatcgattctatcaagcgtgttgaaatcttaggttctgtacaagaaacaattacagacttaccagatttaaatccagaagatttagccgaactacgtactttaggtgaaattgtttcttacatgcagtctaaagtagcagttgcgccagcagttgtttcagcaccagcccaacaagcagcacaagctacaccaagcattgaattaaatcccctttctttgggtaaagtgcaatctgtgatgatggacgtcgtagcagagaaaacaggttaccctgttgacatgctagagcttgaaatggatatggaagctgatttaggcatagactctattaaacgtgttgagattttaggtgcagttcaagagactatttctgacttaccagatttaaacccagaagacttagcagaactacgtactttaggtgaaattgtatctcacatgcaatctaaagttgcagacccagttgcttctcctgaaaatgctgatgtacaagcatcacctagcattgacttaaaccacattcaatctgtcatgatgacagtagtagcagagaaaacgggttaccctgttgaaatgctagagcttgaaatggatatggaagctgatttaggtatagattcaattaagcgtgttgaaattttaggtgcggttcaagaaacaatcacagatttaccagatttaaacccagaagacttagcagagctacgtactttaggtgaaatcgtaacgcatatgcaaagtaaagcgagtggcacaacagatacttcagaggtaactgttgtaaaaaagcctgaagtgcaagtaaatgatgttgtaaaagtcacaggtgcacccagtgctacagtggcaatctcacgtctaacagctgtaaataaaattagccaagatacaaaaggtgcaaatgcattagttgttaatgatggtactgatgcagcagttgaattaagtgagaatttaattaacagtggctggaatgtgactgtgctaaatcctagctgggttacagcacaatcgactaaaaccctgccaagtacggtaaatgaaattgcgatttcaagtgttgatgaaactcagatcagtgagattattacaaaaaatgcgcaattagattctgtgatttatttacacccagaatcaacaattgacagcattgtttatccacaagcgtcgaaacaaggtttagagttagctttcatcttagcgaaattatgtaacgttaaagcagcaaaagtagcacgtgcttcatttatggtggtaacacaccaaggtggacaaattggttttgaatcaaatgatggtgctgttgttagtaaacatactgatttagtccaaggtggtttaaacggtttagttaaaacattatctcatgagtggactgaggctggcgtattctgtcgcgcaattgatgtggcatcaagcttatcagcaactcaagttgcaaacattatcactgatgaattagctgatgtggatactgtgctgagcgaagttggttacgatgaaactggccgtttaactttaattggtgaagcaacagatagctatgcactgacttcaggcaacagcatagataaagactcggtatttttagtcagcggtggcgcaaaaggcgtaactgcacattgtgtaattgaaattgcaaaacagtatcaagctaaatttgttttattaggacgttcgtcttttgatgcaaatgagcctagctgggctaaaggaattaatgatgaagtcgcacttaaaaaagcggctatgcaagcattaatcgcagcaggtgataaaccaactccggttaaagtatctcagtttattcgcccagtattggcaaatcgtgaaattgcgcaaacattaactgcaattgaagctgctggtggccaagcacaatatgtatctgctgatgtaacgaatagtgaaagcgtacaagctgctgtaaaaccagctcttgctgagtttggttctgttactggcattattcacggtgcaggtgtacttgctgataaatttattgagcaaaaaacattagctgaatttgatgcggtatatcgtacaaaaattgatggcttaacatcattattatcagtaactgagcaatcaaatattaaacatttagtattgttctcatcagctgcgggtttttatggcaatccaggacagtctgactattcaattgctaacgatatcttaaataaaacagcttaccgttttaaagcgttaaacccacaagctcaagtattaagctttaattggggtccttgggatggtggcatggtaacgcctgaacttaaacgtatgtttgatgccagaggcgtatatatcataccgctagatgctggagcgcaattattagtaagtgaacttgctgcaacagataaccgttgtgcacaaattcttgttggtaatgacttgtcgaaagatcaagcgcctgaagttgaaggtacagatgtaaaaaagccactagttagtcgtttaacaaaagcattaaaaacgactaacggtacttttacgaatgcattcctagctgatcatgtaataggtggcaatcaagtattgccaactgtatgtgcaattgcttggatgagtgaagctgctatatcactttatactggttaccattaccaaggccttgaaaactacaaattgtttaaaggtttagtatttgatggtacgcaagctgatgaagttaacattgattttaaagtattagccgagagtgctgatactttaaagcttgatgcaaaaatatcgagcactgtttctaatggcagttcaaatggcaaaacagtatttcattatggcgctgagttaacacttgttcgaagccgtaatgaggcaccagtatcaggcttagagctacctgtattgaaatctgatatttcagatgaagctaaagcactttatcaaaatggcactttatttcatggcgaaagcttgcaagggatcattgatgtgatctcatgcaatgactcatcgttattattagggtgttcagtgccaagcattgctcaatctaaacagggagagtttttacttcctgtagaggcgggcagtacaagtcaaaatatatttgctaatgatttagtgtatcaagcgatgttagtttgggttcgtaagcagcttggaatgggcagtttgccttctaaaacattagcttggcaggttaaccgtgaagtgattttaggtgaagcgttttacattgatttaaaagttgtagagcaaacagcatctaagttagtggctgatattgctttaatttcagagcaaaagcaggttttagcgcaagttaaatctgctgaagtgacgatcagcgaaaacttgaataacctttttacaaaaactggcgaggataaaaatgtttaa

SEQ ID NO: 28 - protein, 2682 aa, Pseudoalteromonas sp.
  misc_feature: SGI Peptide ID NO. 277634F
  misc_feature: PfaA polypeptide
  misc_feature: Useful for modulating production of PUFA
  misc_feature (3)..(1530): NCBI GI: 157376334 Blast Desc: erythronolide synthase [Shewanella sediminis HAW-EB3] gi|157318708|gb|ABV37806.1| Erythronolide synthase [Shewanella sediminis HAW-EB3]
  misc_feature (7)..(1512): NCBI GI: 2529418 Blast Desc: [Shewanella sp. SCRC-2738]
  misc_feature (24)..(1514): NCBI GI: 127513593 Blast Desc: beta-ketoacyl synthase [Shewanella loihica PV-4] gi|126638888|gb|ABO24531.1| beta-ketoacyl synthase [Shewanella loihica PV-4]
  misc_feature (24)..(1521): NCBI GI: 113971001 Blast Desc: beta-ketoacyl synthase [Shewanella sp. MR-4] gi|113885685|gb|ABI39737.1| beta-ketoacyl synthase [Shewanella sp. MR-4]
  misc_feature (24)..(1505): NCBI GI: 24373171 Blast Desc: beta keto-acyl synthase [Shewanella oneidensis MR-1] gi|24347382|gb|AAN54658.1|AE015606_4 multi-domain beta-ketoacyl synthase [Shewanella oneidensis MR-1]
  misc_feature (24)..(1520): NCBI GI: 117921281 Blast Desc: beta-ketoacyl synthase [Shewanella sp. ANA-3] gi|117613613|gb|ABK49067.1| beta-ketoacyl synthase [Shewanella sp. ANA-3]
  misc_feature (24)..(1520): NCBI GI: 114048225 Blast Desc: beta-ketoacyl synthase [Shewanella sp. MR-7] gi|113889667|gb|ABI43718.1| beta-ketoacyl synthase [Shewanella sp. MR-7]
  misc_feature (24)..(1363): NCBI GI: 124545156 Blast Desc: beta-ketoacyl synthase [Shewanella putrefaciens 200] gi|124511343|gb|EAY55408.1| beta-ketoacyl synthase [Shewanella putrefaciens 200]
  misc_feature (26)..(1522): NCBI GI: 149369398 Blast Desc: polyunsaturated fatty acid synthase PfaA [unidentified eubacterium SCB49] gi|149356825|gb|EDM45380.1| polyunsaturated fatty acid synthase PfaA [unidentified eubacterium SCB49]
  misc_feature (27)..(1531): NCBI GI: 91218436 Blast Desc: multi-domain beta-ketoacyl synthase [Psychroflexus torquis ATCC 700755] gi|91183427|gb|EAS69828.1| multi-domain beta-ketoacyl synthase [Psychroflexus torquis ATCC 700755]
  misc_feature (34)..(313): Pfam Id: PF00109 Pfam Desc: Beta-ketoacyl synthase, N-terminal domain
  misc_feature (321)..(439): Pfam Id: PF02801 Pfam Desc: Beta-ketoacyl synthase, C-terminal domain
  misc_feature (611)..(939): Pfam Id: PF00698 Pfam Desc: Acyl transferase domain
  misc_feature (1234)..(1300): Pfam Id: PF00550 Pfam Desc: Phosphopantetheine attachment site/acyl carrier protein
  misc_feature (1339)..(1404): Pfam Id: PF00550 Pfam Desc: Phosphopantetheine attachment site/acyl carrier protein
  misc_feature (1441)..(1506): Pfam Id: PF00550 Pfam Desc: Phosphopantetheine attachment site/acyl carrier protein
  misc_feature (1540)..(1605): Pfam Id: PF00550 Pfam Desc: Phosphopantetheine attachment site/acyl carrier protein
  misc_feature (1646)..(1711): Pfam Id: PF00550 Pfam Desc: Phosphopantetheine attachment site/acyl carrier protein
  misc_feature (1744)..(1809): Pfam Id: PF00550 Pfam Desc: Phosphopantetheine attachment site/acyl carrier protein
  misc_feature (2093)..(2318): Pfam Id: PF08659 Pfam Desc: Ketoreductase domain (KR)
  misc_feature (2175)..(2297): Pfam Id: PF00106 Pfam Desc: short chain dehydrogenase
  misc_feature (2400)..(2667): Pfam Id: PF14765 Pfam Desc: polyketide synthase dehydratase domain (PS-DH)
MSNKSQAKPALAKTVKDVDALVDEQQFNSRLQECPIAIVGMASVFADATNLDQYWDNIFESVDSIRDVPADRWAIDDYYSEDKFAADKTYCKRGGFLPEIDFDPMEFGLPPNILELTDIAQLLSLVVARDVLNDAGIGEGSGYDRDKVGITLGVGGGQKQISPLTSRLQGPVLEKVLKASGVDAEDRAMIIEKFKKAYIGWEENSFPGMLGNVISGRIANRFDFGGTNCVVDAACAGSLAAVKLAISDLLEHRSEVMISGGVCCDNSPFMYMSFSKTPAFTTNDDIRPFDDDSKGMMIGEGIGMMAFKRLEDAERDGDKVYAVLKGIGTSSDGRFKSIYAPRPDGQAKALKRAYEDAGWDPKTCGLIEAHGTGTKAGDAAEFAGLTKHFGADNDKTQHIALGSVKSQVGHTKAAAGSAGMIKAVLALHHKVLPGTLHIDQPNTNLDIENSPLYLNSQTRPWMPREDGLPRRAGVSSFGFGGTNYHMVLEEYQPKAEGEYRITAVPQSILLTAENEAGIVAQLNDHLTQLSVDADARVFAFNRLVTQSVATKPATELARCGFIAKNASQAIDMINAALKQFKAKAGDVQWSVPTGIYYRQSGIDAKGKVVALFSGQGSQYVNMGNELACNFPSVMQSAADMDAQFASAGLSHLSNVTYPIPVFNDADRKAQDEALRLTQHAQPAIGCFSVGLYNTFKQAGFAADFTAGHSFGELTALWAAGVLNDNDYMMLARSRGQAMAAPEDENFDAGTMIAVVGDPVKVSDDIKDIKDISIANYNSNNQVVVAGVTNQIEIAMGELKAKGYKVVPLPVSAAFHTPLVGHAQKPFAKAIDSAKFTKPSIPVFANGTGKAHPNKAAEIKKSLKNHILESVHFNDEIDNLYDAGGRIFIEFGPKNVLTKLVENILTEKSDVTAIAINANPKKSADLQMRQAAMQMLVLGVDLNEIDPYSAIKRPLEAAKKSPLAMKLTGASYVSPKTKKAFDDALTDGWTIKQAKAQPVSVPQPKVVEKIVEKIVEVEKVVEKIVYVQADGSHTNTPNAAATATNADELASNIERSVGQFVEHQQQLLNVHEQYMQGPQEYAKTFQSVLEAQTGNELPESLDRTLGMYHEFQSETLRVHEQYLNNQTDNMSAMLNDVQEAPSVSVDTKQTVTKAPVVKAAVPVAAKSVPVKPVTEVKTPVTPAPVKTAAKSITPVQTAATAVAIAPEVVTAAPVVKPQVETVAAFDLNKVNTVMLEVVADKTGYPAEMLELEMDMEADLGIDSIKRVEILGSVQEMIPDLPDLNPEDLAELRTLGEIVDYMKSKAQAATPTNVSSAPALHLVETDSVPSIDLNHIQSVMMEVVADKTGYPVEMLELEMDMEADLGIDSIKRVEILGSVQETIADLPDLNPEDLAELRTLGEIVSYMQSKVSAAPVTTSEVVSAGVTQVAPSIDLNHIQSVMMAVVAEKTGYPVEMLELEMDMEADLGIDSIKRVEILGSVQETITDLPDLNPEDLAELRTLGEIVSYMQSKVSVAPTAVVSAPVEQAAPSIDLNHIQSVMMTVVAEKTGYPVEMLELEMDMEADLGIDSIKRVEILGSVQETITDLPDLNPEDLAELRTLGEIVSYMQSKVAVAPAVVSAPAQQAAQATPSIELNPLSLGKVQSVMMDVVAEKTGYPVDMLELEMDMEADLGIDSIKRVEILGAVQETISDLPDLNPEDLAELRTLGEIVSHMQSKVADPVASPENADVQASPSIDLNHIQSVMMTVVAEKTGYPVEMLELEMDMEADLGIDSIKRVEILGAVQETITDLPDLNPEDLAELRTLGEIVTHMQSKASGTTDTSEVTVVKKPEVQVNDVVKVTGAPSATVAISRLTAVNKISQDTKGANALVVNDGTDAAVELSENLINSGWNVTVLNPSWVTAQSTKTLPSTVNEIAISSVDETQISEIITKNAQLDSVIYLHPESTIDSIVYPQASKQGLELAFILAKLCNVKAAKVARASFMVVTHQGGQIGFESNDGAVVSKHTDLVQGGLNGLVKTLSHEWTEAGVFCRAIDVASSLSATQVANIITDELADVDTVLSEVGYDETGRLTLIGEATDSYALTSGNSIDKDSVFLVSGGAKGVTAHCVIEIAKQYQAKFVLLGRSSFDANEPSWAKGINDEVALKKAAMQALIAAGDKPTPVKVSQFIRPVLANREIAQTLTAIEAAGGQAQYVSADVTNSESVQAAVKPALAEFGSVTGIIHGAGVLADKFIEQKTLAEFDAVYRTKIDGLTSLLSVTEQSNIKHLVLFSSAAGFYGNPGQSDYSIANDILNKTAYRFKALNPQAQVLSFNWGPWDGGMVTPELKRMFDARGVYIIPLDAGAQLLVSELAATDNRCAQILVGNDLSKDQAPEVEGTDVKKPLVSRLTKALKTTNGTFTNAFLADHVIGGNQVLPTVCAIAWMSEAAISLYTGYHYQGLENYKLFKGLVFDGTQADEVNIDFKVLAESADTLKLDAKISSTVSNGSSNGKTVFHYGAELTLVRSRNEAPVSGLELPVLKSDISDEAKALYQNGTLFHGESLQGIIDVISCNDSSLLLGCSVPSIAQSKQGEFLLPVEAGSTSQNIFANDLVYQAMLVWVRKQLGMGSLPSKTLAWQVNREVILGEAFYIDLKVVEQTASKLVADIALISEQKQVLAQVKSAEVTISENLNNLFTKTGEDKNV

SEQ ID NO: 29 - DNA, 2400 bp, Pseudoalteromonas sp.
  misc_feature: SGI cDNA ID NO. 278767
  misc_feature: PfaB gene
  misc_feature: Encodes the peptide sequence at SEQ ID NO 30
  misc_feature: Useful for modulating production of PUFA
atgtttaatacaaatttatctatcgttggcttagatgccaattttggtggttattcaaatatagatttagttgaacgtgctttttatcaaggcagtgcagctaagcaagtaaatttaccgacaagttcagttaaatctgaacttgtaacatcatctgttttacgtttagcaaaggcaaataagttaaatattgatgcgcttaatatcattgagctgtcaaaaaatacagatttatcatctgctttagcgaaaacacaagaacttgttaatgccaataaacttgttgttttagttggggttaatttattagcctcacctattgaacaagacaatatatcggcaacaatggcttttgatgaaagctttacgcattacaatcaagtagaaggtatagtgagccttttaattgcaccaagtgactttgcaatcaaaaatgctttgtatacttatgctaacataaaaagttttgctgctggttctgatattgctcacacaacagcccaagcgcttgaaaaagcaaatgttacggctgagcaagtacacttacttgaagtatctgcaaatgcagataaagcgtttgcaaatattgaagaacaaggtttattacgcgcttataaaactgatacaaaattaaataccgcgttaagttgtactaaaagtgtgacaggtgagggcgatgcgttctcacaattagccggtttgttaaaatgtatcatttcattgcaacaaagatatattcctgcgataagtggttggcaaaatgttcagcctgatgtgttatctcaatatcaagactctgctttttatattccaacagagtctcgtccttggtatccaaattctgatggcagtgcacatatcgcagcttatagttgccaaacagaaaatagctattgtcatattgtattagaagaaaatttattaccggctacgtcattaacaacgggtgagcgttttcctgctgaagatgtacgtaataatggttttatcgcaaatagtgatttatcagtatttttattatcggctgatgatgaaaagtcactattagacaatgtagcgagtttaaatagccaaacatctttgccgataaatgaacttgctaagtcatgttttgcacaatttgatgctcaaaagcaattttctgttgtattactggctgaatctttcgatgagttaagtaaagaaatcgcattagctgagcaaggcatatcaaaagcatttttagatagcagtgattggaaaacacctaaaggcagttattttactgcaaaaccagttggtgctggagagaatatctcatttatgtatccaggaataggcgcaacttatgtaggtttaggtcgtgatttatttcatatattcccgcaaatatatcaaggtgttgccgcacttgcagatgatattgcgataacactaaaagatacattactgaaccctagaagcattaatcgtttaggttttaaagaactgaaacaaagagatttagcattacgtggcagtttagctgatattgctgaagcgggtgtgggttatgcatgtgttttcactaaaatatttgaagatgtatttaatgtaaaagccgactttgctactggctatagtatgggtgaagtcagcatgtatgcagctctaggctgttggcaacaacctggcttaatgagcgcgcgtttagctgcatcagatactttcaataataaattatgtggtgatttactgactttacgtgaccaatggaatatgccaaaaacgtcttctgaaacagaagtgatttgggaaacctataccattaaggccactgttgaggaatttgagttagcaagtgttgatgagcctcaagttttctgcaccatagttaatacaccagacagcttattagttgcgggttatccgccagcttgccaaaaagtgattaaaaaactaggtgtacgtgcaatggcactgaatatggccaatgcaatacatagtgcgccagcgaattctgaatatgatgctatgacaggcctgtatactatggatgtgacagaacgcatcaaaaccaaaatgtattcaagttcatgttatttacctattccacaacgtagcaaagcaattgcaaccagcattgctaaatgcttgtgtgatcgtgttgattttccgcgtttagtaaataccttgcacgataaaggcgcacaagtatttattgaaatgggacctgggcgttcattatctagttgggtggataaaattttagattccgatgttactcaaaatgcagattcaaatcatttatcagtgccagttaatgcaaaaggcacaagtgatgaactgacgtatatgcgtgctgtagctaagttgataagtcatggtgtgatcatggagctaagtcatttgttccatggttctatcgtggttgaaaaataa

SEQ ID NO: 30 - protein, 799 aa, Pseudoalteromonas sp.
  misc_feature: SGI Peptide ID NO. 278767
  misc_feature: PfaB polypeptide
  misc_feature: Useful for modulating production of PUFA
  misc_feature (2)..(796): NCBI GI: 119945396 Blast Desc: polyunsaturated fatty acid synthase PfaB [Psychromonas ingrahamii 37] gi|119864000|gb|ABM03477.1| polyunsaturated fatty acid synthase PfaB [Psychromonas ingrahamii 37]
  misc_feature (4)..(787): NCBI GI: 6691655 Blast Desc: protein product [Moritella marina]
  misc_feature (4)..(746): NCBI GI: 149909574 Blast Desc: polyunsaturated fatty acid synthase PfaB [Moritella sp. PE36] gi|149807278|gb|EDM67231.1| polyunsaturated fatty acid synthase PfaB [Moritella sp. PE36]
  misc_feature (6)..(796): NCBI GI: 90408111 Blast Desc: heterocyst glycolipid synthase [Psychromonas sp. CNPT3] gi|90310797|gb|EAS38912.1| heterocyst glycolipid synthase [Psychromonas sp. CNPT3]
  misc_feature (7)..(799): NCBI GI: 71279011 Blast Desc: polyunsaturated fatty acid synthase PfaB [Colwellia psychrerythraea 34H] gi|71144751|gb|AAZ25224.1| polyunsaturated fatty acid synthase PfaB [Colwellia psychrerythraea 34H]
  misc_feature (51)..(791): NCBI GI: 119509815 Blast Desc: heterocyst glycolipid synthase [Nodularia spumigena CCY9414] gi|119465550|gb|EAW46443.1| heterocyst glycolipid synthase [Nodularia spumigena CCY9414]
  misc_feature (115)..(798): NCBI GI: 17232847 Blast Desc: heterocyst glycolipid synthase [Nostoc sp. PCC 7120] gi|17134494|dbj|BAB77054.1| heterocyst glycolipid synthase [Nostoc sp. PCC 7120]
  misc_feature (115)..(798): NCBI GI: 75908807 Blast Desc: beta-ketoacyl synthase [Anabaena variabilis ATCC 29413] gi|75702532|gb|ABA22208.1| Beta-ketoacyl synthase [Anabaena variabilis ATCC 29413]
  misc_feature (115)..(791): NCBI GI: 282900688 Blast Desc: hglC (Beta-ketoacyl synthase) [Cylindrospermopsis raciborskii CS-505] gi|281194488|gb|EFA69443.1| hglC (Beta-ketoacyl synthase) [Cylindrospermopsis raciborskii CS-505]
  misc_feature (115)..(792): NCBI GI: 298492363 Blast Desc: PfaB family protein ['Nostoc azollae' 0708] gi|298234281|gb|ADI65417.1| PfaB family protein ['Nostoc azollae' 0708]
  misc_feature (159)..(249): Pfam Id: PF02801 Pfam Desc: Beta-ketoacyl synthase, C-terminal domain
  misc_feature (602)..(776): Pfam Id: PF00698 Pfam Desc: Acyl transferase domain
MFNTNLSIVGLDANFGGYSNIDLVERAFYQGSAAKQVNLPTSSVKSELVTSSVLRLAKANKLNIDALNIIELSKNTDLSSALAKTQELVNANKLVVLVGVNLLASPIEQDNISATMAFDESFTHYNQVEGIVSLLIAPSDFAIKNALYTYANIKSFAAGSDIAHTTAQALEKANVTAEQVHLLEVSANADKAFANIEEQGLLRAYKTDTKLNTALSCTKSVTGEGDAFSQLAGLLKCIISLQQRYIPAISGWQNVQPDVLSQYQDSAFYIPTESRPWYPNSDGSAHIAAYSCQTENSYCHIVLEENLLPATSLTTGERFPAEDVRNNGFIANSDLSVFLLSADDEKSLLDNVASLNSQTSLPINELAKSCFAQFDAQKQFSVVLLAESFDELSKEIALAEQGISKAFLDSSDWKTPKGSYFTAKPVGAGENISFMYPGIGATYVGLGRDLFHIFPQIYQGVAALADDIAITLKDTLLNPRSINRLGFKELKQRDLALRGSLADIAEAGVGYACVFTKIFEDVFNVKADFATGYSMGEVSMYAALGCWQQPGLMSARLAASDTFNNKLCGDLLTLRDQWNMPKTSSETEVIWETYTIKATVEEFELASVDEPQVFCTIVNTPDSLLVAGYPPACQKVIKKLGVRAMALNMANAIHSAPANSEYDAMTGLYTMDVTERIKTKMYSSSCYLPIPQRSKAIATSIAKCLCDRVDFPRLVNTLHDKGAQVFIEMGPGRSLSSWVDKILDSDVTQNADSNHLSVPVNAKGTSDELTYMRAVAKLISHGVIMELSHLFHGSIVVEK

SEQ ID NO: 31 - DNA, 5811 bp, Pseudoalteromonas sp.
  misc_feature: SGI cDNA ID NO. 278744
  misc_feature: PfaC gene
  misc_feature: Encodes the peptide sequence at SEQ ID NO 32
  misc_feature: Useful for modulating production of PUFA
atggaaaatattgcagtagtaggtattgctaatttattcccaggttcacaagcgcctgaagaattttggcaaaagctgctagaacaacaagattgtcgctctaaagcaaatagcgaacaaatgggtgtagatccagctaaatattatggtaacaaaggtgatatagataagttttattgtattcatggcggttacattcgtgactttaactttgatgcagatgatgtattacaagaaaacagcccacttagcccacaatatttagaacaattagatgacttaaaccaatggtcactctatgtgacaaaacaagcattaaaagatgcgggttattggggcagtaatgtacttgaaaactgcggtttgattttaggaaacttatcttttccaactaaatcatcaaatcatttatttatgccgttatatcatcaagttgtcgataacgcgttaaagcaaacagtgcataaagatttttcactgagccattttacccagacaaaaacagatgtgcatccagataatgcattagttgcgggttatcctgctgcgttattagcacaagctgctggcctaggtggctcacactttgcactagatgctgcgtgtgcatcttcatgttactcagtaaaacttgcgtgtgattatttacatacaggcaaagcagacatgatgttagcgggcgcagtatcaggctctgatcctatgtttgtaaatatgggtttttctatatttcaggcatacccagcgaataacatacatgcaccgtttgataaaaattcacaaggtttatttgccggtgaaggcgcgggcatgatggtattaaaacgtcatagtgatgcggtacgcgatggcgataaaattcacgcgattattaaaggcggtggtttatcaaacgatggtaaaggggagtttgttttaagtcctaataccaaaggccaagtgttagtatatgaacgtgcatatcaaaatgccgacgtaaaccctaaagatgttgattacattgaatgtcacgcaacgggcacaccaaaaggtgacaaagttgaattaggctcaatggatactttctttagtcgttatgataataaaccactattaggctcagtaaagtctaatttgggccatttattaacggctgcaggtatgccgggtatgaccaaagcaatttgggcgcttaataaaaaacaaattcctgcgacaattaatttaaatgagccgcttagctctaaaaacggttatttaactggcgaacaaatgccaagtgaattaacgccttggccagatactttggttaatggcgcgcaaaagccaagaacggcgggtgtcagtgtatttggttttggtggtgcaaatgcgcatttagttttacaagagccaactcaagttttagagcctattaacgaggtagctaaaaagagtgaaccattagccattgttggtatggatgcgcattttggacatgctcaaaacctaagtgaatttaaaaaggtaattgactctaataccaatacatttagagagttgcctaccaatcgctggaaaggtatcgaaactaatagccaagtaatgcaagcgttacagttagaaaaagcaccaatcggtggttacgttgaagactttgatatcgactttttacgttttaaagtgccaccaaatgagcaagactgcttaattccacaacaacttatgatgatgaaagtggcagataatgccgctaaagatgcaggacttaaagaagggtcaaatgtagctgttttagtggctatgggtgttgagcttgaactgcaccaatatcgcggtcgtgtaaatttaacaacgcaaattgaaaccagccttaaacagcaaggtatttcgcttacattagagcaacaagctgagctgactaatatcgccaaagatggtgtggcatttgctgcacaacttaaccaatataccagctttattggcaatattatggcatcgcgtatctcagctttatgggatttttcaggcccagcatttacattatcagctgaagaaaactcagtatatcgctgtgttgaattagcgcaaaacttgtttctaactagcgatatagatgctgttattattgcaagtgttgatttagcaggctctgctgaaaatattacattacgccaacattacggtcctgtatcgaaagatggacaagctaataaaaatcactggttagtgggtgagggcgctggtgcatttgtagttaaaccacaatcaaaagttaatgcacaaaacacctatgcaaccattgatggaattggtttttctgcaggtattgatgaagaatcagtacttaatgcggcagaaaaagcacttgcaactgctaatgtatctgcatcagatattagcaaaatagaagcccatgcaagtggttttattgctgaagataacgcagagcaagccgcttttaattcactttatgcaacacaagttgccagtaataatattagtagtgttaagtctaatgtaggtcatacgtttaatgcctcaggtgttgccagtattattaaatcagcacttgttttagataagcaagaatcatcacatattgcaattagtggcctaggcagagatgcaactagtgcgcacttagtgttatctggcacaaatacaacttatcaatccagtgccgtagcaccagttaaaaaacgccctcagttgattaaaaaaattagcttaggcggtcaaaaaattgctgagtcaattacatcacatgattcggctgttattgcacaaataaaacagaatcttattactaaaacattggcaccgatttcatgccctgtagatattagtaatttaccccctaagcagataaatacgattaaagcagttgcagaagttaaacctgttattgcacaaactgctaacgttggagcaactgtgaaaagtactcaatcaaatacgaaaaaaattgcaaatacagtaaacgtgagtagtaaagcgagtaaagaaatttaccagcaatcagctacccatgaagcatttttgaaaacgcgccaagctgcacaacagcatatttctcaattagtagaaatacaggcaaaactagtttcaggcggccaagttaatacggttgctaaaaagccggttttatcagttgtaccagagcaagtgccattagcacctgttgcacaagaaattgaatctggttttcaaataaaaggtcctgcgggttacagttatccgccattacaacttcaagagcgtttcaatcaacctaaaaatattatttgggatacagttgatttagttgaatttgccgaaggcgatatcggcaaagtatttggtagagaatacgatattatcgataattattctcgtcgtgtacgtttacctacaaccgattatttattagtaagtcgtgttactgagctagatgcaaaagtaaacgaatataaaaaatcatatatgtgtactgaatatgatattccgacagatgcaccatttttaattgatggccagatcccttggtcagtatcagttgaatcaggccaatgtgatttattattaatttcatatatcggtattgattttgaagcaaaaggcgaacgcgtttatcgtttattagattgtgagttaacattcttagaagaaatggcctttggtggtgaaacgttacgctacgaaattcatatcgattcgtatgctaaaaatggcgaccagttattgtttttcttccactacgattgttatgttggcgataaaaaagtacttattatgcgtaatggttgtgctggcttcttcactgatgaagaacttgctgatggcaaaggcgttattcataacgacaaagacaaagcacaattagccaatgctaaaaagtcgtactttgagccattaatgcaaaataaccaagcgacatttgattatacagagatgatgaagctagttaatggtgacgttgcaggctgttttggtgataattatgaccaaggtggtcgtaatccttcattgaaattttcgtcagaaaaattcttaatgattgagcgtatcactaaaattgatacacatggcggtcattggggcttaggtttacttgaaggtcaaaaagacttagatccagaacattggtatttcccatgtcactttaaagacgaccaagtaatggctggctcattaatgagtgaaggttgtggtcaaatggccatgttctttatgctgaaattaggcatgcatattaatgttaataatgcacgttttcagcctatgccaggtatgtcacaaacggtgcgttgtcgtggccaagttataccacaacataatactttgacttatcgcatggaagtaacagaaatgggcatggaaccatacccatttatgaaagctaacatagatattattcttgatggcaaagtggtagtggatttcaaaaacttatgtgtgatgatcacagagcaagatgaaaattctccttacccagtgactttacctgataatacacagttacttgaagtgaaatctacaagtgttgaagttgctaaagaaagtcacattgatgaaagccaattagatgaaagaggtgtaaacccttttaaaaatcctgaacgtcctttaatgcgtgtagagtctgatttaactgcaccaaaagaaaaaggtgtaacaccaattcagcattttgaagcaccacttgtagctggtcaaaatcgcgtaccaaaccaagcaccgtttacaccttggcacatgtttgagttcgcaacaggtaatatttctaactgttttggtcctgactttgatgtttataaaggtcgcattccaccacgtacaccttgtggtgatttacaggtagtaacgcaagttgttgaagtgaaaggtaagcgattagaccttaaaaatccttcaagctgtattgctgagtattatgtgcctgaagacgcatggtatttcactaaaaatagccacgaaagctggatgccatattcattaattatggaaattgcattacaaccaaacggttttatttcaggttatatgggaactacgcttaaataccctgaaaaagacctatttttccgtaacctagatggtagcggtgatctagttaaacaaattgacttacgtggcaaaacgattgttaataaatcagtattattaagcaccactatggccggtggcatgatagtacaaagctttacgtttgagcttttagtcgaagatgaagtattttataaaggaacagctgtatttggttactttggtgctgatgcactgacaaatcagttaggcatcgataatggtaaaatcactcaagcttggtttgaagataataaaacaccattatctcaaattgaaaaactagatttaaccaataaaaacttagccctttaccaagcaccacaaggtaaaccgcattataaattagcgggtggccaaatgaactttattgatacagtttcaattgttgaaggcggcggtaaagcgggtgttgcttatgtacatggtgaacgtcaaatagatgcaacagattggttcttccgttatcacttccaccaagatccggtaatgccaggttctttaggtgtagaagcaataatagaattaatgcaaacctatgcacttaaaaatgatttaggtaaagactttgcaaacccaagatttattgcacctactaccttagtaaaatggaaataccgagggcaaattacacctatcaataaacaaatgtctttagatgtgcatattactgacattattaaaacagatggtgaaatacgcttagtgggcgatgctaatttatctaaagacggcttacgtatctacgaagtaaaagatattgtactgtcaatcattgaagcataa

SEQ ID NO: 32 - protein, 1936 aa, Pseudoalteromonas sp.
  misc_feature: SGI Peptide ID NO. 278744
  misc_feature: PfaC polypeptide
  misc_feature: Useful for modulating production of PUFA
  misc_feature (1)..(1936): NCBI GI: 71278985 Blast Desc: polyunsaturated fatty acid synthase PfaC [Colwellia psychrerythraea 34H] gi|71144725|gb|AAZ25198.1| polyunsaturated fatty acid synthase PfaC [Colwellia psychrerythraea 34H]
  misc_feature (1)..(1936): NCBI GI: 149912083 Blast Desc: polyunsaturated fatty acid synthase PfaC [Moritella sp. PE36] gi|149804849|gb|EDM64887.1| polyunsaturated fatty acid synthase PfaC [Moritella sp. PE36]
  misc_feature (1)..(1936): NCBI GI: 6691656 Blast Desc: protein product [Moritella marina]
  misc_feature (1)..(1936): NCBI GI: 119945397 Blast Desc: polyunsaturated fatty acid synthase PfaC [Psychromonas ingrahamii 37] gi|119864001|gb|ABM03478.1| polyunsaturated fatty acid synthase PfaC [Psychromonas ingrahamii 37]
  misc_feature (1)..(1935): NCBI GI: 90408110 Blast Desc: multi-domain beta-ketoacyl synthase [Psychromonas sp. CNPT3] gi|90310796|gb|EAS38911.1| multi-domain beta-ketoacyl synthase [Psychromonas sp. CNPT3]
  misc_feature (2)..(280): Pfam Id: PF00109 Pfam Desc: Beta-ketoacyl synthase, N-terminal domain
  misc_feature (4)..(1936): NCBI GI: 90413867 Blast Desc: omega-3 polyunsaturated fatty acid synthase PfaC [Photobacterium profundum 3TCK] gi|90325051|gb|EAS41561.1| omega-3 polyunsaturated fatty acid synthase PfaC [Photobacterium
  misc_feature (4)..(1936): NCBI GI: 84387723 Blast Desc: omega-3 polyunsaturated fatty acid synthase PfaC [Vibrio splendidus 12B01] gi|84377406|gb|EAP94273.1| omega-3 polyunsaturated fatty acid synthase PfaC [Vibrio splendidus
  misc_feature (4)..(1936): NCBI GI: 218710185 Blast Desc: omega-3 polyunsaturated fatty acid synthase PfaC [Vibrio splendidus LGP32] gi|218323204|emb|CAV19381.1| PfaC, omega-3 polyunsaturated fatty acid synthase [Vibrio splendidus
  misc_feature (4)..(1936): NCBI GI: 86147637 Blast Desc: omega-3 polyunsaturated fatty acid synthase PfaC [Vibrio sp. MED222] gi|85834548|gb|EAQ52697.1| omega-3 polyunsaturated fatty acid synthase PfaC [Vibrio sp. MED222]
  misc_feature (4)..(1936): NCBI GI: 54308651 Blast Desc: omega-3 polyunsaturated fatty acid synthase PfaC [Photobacterium profundum SS9] gi|46913080|emb|CAG19869.1| omega-3 polyunsaturated fatty acid synthase PfaC [Photobacterium
  misc_feature (289)..(402): Pfam Id: PF02801 Pfam Desc: Beta-ketoacyl synthase, C-terminal domain
  misc_feature (473)..(743): Pfam Id: PF00109 Pfam Desc: Beta-ketoacyl synthase, N-terminal domain
  misc_feature (767)..(849): Pfam Id: PF02801 Pfam Desc: Beta-ketoacyl synthase, C-terminal domain
  misc_feature (1328)..(1461): Pfam Id: PF07977 Pfam Desc: FabA-like domain
  misc_feature (1793)..(1927): Pfam Id: PF07977 Pfam Desc: FabA-like domain
MENIAVVGIANLFPGSQAPEEFWQKLLEQQDCRSKANSEQMGVDPAKYYGNKGDIDKFYCIHGGYIRDFNFDADDVLQENSPLSPQYLEQLDDLNQWSLYVTKQALKDAGYWGSNVLENCGLILGNLSFPTKSSNHLFMPLYHQVVDNALKQTVHKDFSLSHFTQTKTDVHPDNALVAGYPAALLAQAAGLGGSHFALDAACASSCYSVKLACDYLHTGKADMMLAGAVSGSDPMFVNMGFSIFQAYPANNIHAPFDKNSQGLFAGEGAGMMVLKRHSDAVRDGDKIHAIIKGGGLSNDGKGEFVLSPNTKGQVLVYERAYQNADVNPKDVDYIECHATGTPKGDKVELGSMDTFFSRYDNKPLLGSVKSNLGHLLTAAGMPGMTKAIWALNKKQIPATINLNEPLSSKNGYLTGEQMPSELTPWPDTLVNGAQKPRTAGVSVFGFGGANAHLVLQEPTQVLEPINEVAKKSEPLAIVGMDAHFGHAQNLSEFKKVIDSNTNTFRELPTNRWKGIETNSQVMQALQLEKAPIGGYVEDFDIDFLRFKVPPNEQDCLIPQQLMMMKVADNAAKDAGLKEGSNVAVLVAMGVELELHQYRGRVNLTTQIETSLKQQGISLTLEQQAELTNIAKDGVAFAAQLNQYTSFIGNIMASRISALWDFSGPAFTLSAEENSVYRCVELAQNLFLTSDIDAVIIASVDLAGSAENITLRQHYGPVSKDGQANKNHWLVGEGAGAFVVKPQSKVNAQNTYATIDGIGFSAGIDEESVLNAAEKALATANVSASDISKIEAHASGFIAEDNAEQAAFNSLYATQVASNNISSVKSNVGHTFNASGVASIIKSALVLDKQESSHIAISGLGRDATSAHLVLSGTNTTYQSSAVAPVKKRPQLIKKISLGGQKIAESITSHDSAVIAQIKQNLITKTLAPISCPVDISNLPPKQINTIKAVAEVKPVIAQTANVGATVKSTQSNTKKIANTVNVSSKASKEIYQQSATHEAFLKTRQAAQQHISQLVEIQAKLVSGGQVNTVAKKPVLSVVPEQVPLAPVAQEIESGFQIKGPAGYSYPPLQLQERFNQPKNIIWDTVDLVEFAEGDIGKVFGREYDIIDNYSRRVRLPTTDYLLVSRVTELDAKVNEYKKSYMCTEYDIPTDAPFLIDGQIPWSVSVESGQCDLLLISYIGIDFEAKGERVYRLLDCELTFLEEMAFGGETLRYEIHIDSYAKNGDQLLFFFHYDCYVGDKKVLIMRNGCAGFFTDEELADGKGVIHNDKDKAQLANAKKSYFEPLMQNNQATFDYTEMMKLVNGDVAGCFGDNYDQGGRNPSLKFSSEKFLMIERITKIDTHGGHWGLGLLEGQKDLDPEHWYFPCHFKDDQVMAGSLMSEGCGQMAMFFMLKLGMHINVNNARFQPMPGMSQTVRCRGQVIPQHNTLTYRMEVTEMGMEPYPFMKANIDIILDGKVVVDFKNLCVMITEQDENSPYPVTLPDNTQLLEVKSTSVEVAKESHIDESQLDERGVNPFKNPERPLMRVESDLTAPKEKGVTPIQHFEAPLVAGQNRVPNQAPFTPWHMFEFATGNISNCFGPDFDVYKGRIPPRTPCGDLQVVTQVVEVKGKRLDLKNPSSCIAEYYVPEDAWYFTKNSHESWMPYSLIMEIALQPNGFISGYMGTTLKYPEKDLFFRNLDGSGDLVKQIDLRGKTIVNKSVLLSTTMAGGMIVQSFTFELLVEDEVFYKGTAVFGYFGADALTNQLGIDNGKITQAWFEDNKTPLSQIEKLDLTNKNLALYQAPQGKPHYKLAGGQMNFIDTVSIVEGGGKAGVAYVHGERQIDATDWFFRYHFHQDPVMPGSLGVEAIIELMQTYALKNDLGKDFANPRFIAPTTLVKWKYRGQITPINKQMSLDVHITDIIKTDGEIRLVGDANLSKDGLRIYEVKDIVLSIIEA

SEQ ID NO: 33 - DNA, 1590 bp, Pseudoalteromonas sp.
  misc_feature: SGI cDNA ID NO. 278745
  misc_feature: PfaD gene
  misc_feature: Encodes the peptide sequence at SEQ ID NO 34
  misc_feature: Useful for modulating production of PUFA
atgttagacataaataacaataatattgattgggcgtggaaagtcgataattctgctattcaaactcaaagcagtgccataaaagccgctttaatggatttaactaatccagtatatgtagcaaaaaatggcgcacaagcgggcatagcaaatagcatttcagcatcaggttctgaagatgtgttagcttttgcacaaaagctgaatccagaggatttaggcgatgatgcttataagaaacagcatggcgtgaaatacgcataccatggtggcgcgatggcaaatggcatcgcatcagtagagttagtggttgctttaggtaaagcgggttttttatgttcatttggtgcagcaggcttagtacccgatgtcattgaagagtcaattaagcgtattcaggcagaattaccaaatggaccatatgctgtaaacttaattcatgcgccggcagaagaagcgcttgaacgtggtgctgtagagcgctttttaaaattaggcgtaaaaacagtagaagcatcagcttacttaggtttaactgagcacattgtttggtatcgtgttgcaggtttatcaaaaaatgcagatggctcagtgaatattggccacaaggtaatagcaaaagtatctcgtacagaagtaggtcgtcgctttatggagcctgcacctaaaaaactactagataagctattagcgcaaggaaaaatcacccaagaacaagctgaattatcgcaattagtgccaatggctgatgatataacagcagaagctgattctggtggtcacacagataatcgtccatttttgactttattaccgactatcattgcactacgtgatgaagtgcaagctaaatataacttctcaccagcattacgtgtaggtgctggtggcggtattggtacgcctgaagcagcactggctgcttttaatatgggcgcagcttatattgttttaggttcagtgaaccaagcatgtgttgaagcgggtgcttctgaatatacgcgtaaattattagctaatgttgaaatggccgatgtgactatggcacctgctgctgatatgtttgaaatgggcgtaaaactgcaagttgtaaaacgcggctctatgtttgctatgcgcgctaaaaaactttacgacttatatgtagcttatgattcaattgaagatattccagctgatgaacgtttaaaaattgaaaagcaaattttccgttctaatttagatgatgtatgggcaggcactgagtcatttttccaacagcgcgatcctgaaatgttagcccgcgcacaaagcagccctaaacgtaaaatggcattgatattccgttggtacttaggtttatcatctcgttggtcgaatattggtgaaaaaggccgtgaaatggattaccaaatatgggctggcccaagtttaggtgcatttaatagctgggtaaaaggcacatacttagaagactttacacgtcgcggtgcagtagatgtggcattacacatgttaaaaggtgctgcatatttacaacgtgtgaacatgcttaaatcacaaggtgttacttttacaactgagcttgctagttatcgcaccgatgattag

SEQ ID NO: 34 - protein, 529 aa, Pseudoalteromonas sp.
  misc_feature: SGI Peptide ID NO. 278745
  misc_feature: PfaD polypeptide
  misc_feature: Useful for modulating production of PUFA
  misc_feature (1)..(525): NCBI GI: 90408109 Blast Desc: PCNPT3_08200 [Psychromonas sp. CNPT3] gi|90310795|gb|EAS38910.1| PCNPT3_08200 [Psychromonas sp. CNPT3]
  misc_feature (4)..(526): NCBI GI: 86147638 Blast Desc: omega-3 polyunsaturated fatty acid synthase PfaD [Vibrio sp. MED222] gi|85834549|gb|EAQ52698.1| omega-3 polyunsaturated fatty acid synthase PfaD [Vibrio sp. MED222]
  misc_feature (4)..(526): NCBI GI: 84387722 Blast Desc: omega-3 polyunsaturated fatty acid synthase PfaD [Vibrio splendidus 12B01] gi|84377405|gb|EAP94272.1| omega-3 polyunsaturated fatty acid synthase PfaD [Vibrio splendidus
  misc_feature (4)..(526): NCBI GI: 218710186 Blast Desc: omega-3 polyunsaturated fatty acid synthase PfaD [Vibrio splendidus LGP32] gi|218323205|emb|CAV19382.1| PfaD, omega-3 polyunsaturated fatty acid synthase [Vibrio splendidus
  misc_feature (5)..(529): NCBI GI: 71281382 Blast Desc: polyunsaturated fatty acid synthase PfaD [Colwellia psychrerythraea 34H] gi|71147122|gb|AAZ27595.1| polyunsaturated fatty acid synthase PfaD [Colwellia psychrerythraea 34H]
  misc_feature (5)..(529): NCBI GI: 149912082 Blast Desc: polyunsaturated fatty acid synthase PfaD [Moritella sp. PE36] gi|149804848|gb|EDM64886.1| polyunsaturated fatty acid synthase PfaD [Moritella sp. PE36]
  misc_feature (5)..(525): NCBI GI: 119945398 Blast Desc: polyunsaturated fatty acid synthase PfaD [Psychromonas ingrahamii 37] gi|119864002|gb|ABM03479.1| polyunsaturated fatty acid synthase PfaD [Psychromonas ingrahamii 37]
  misc_feature (5)..(526): NCBI GI: 157376337 Blast Desc: 2-nitropropane dioxygenase, NPD [Shewanella sediminis HAW-EB3] gi|157318711|gb|ABV37809.1| 2-nitropropane dioxygenase, NPD [Shewanella sediminis HAW-EB3]
  misc_feature (11)..(529): NCBI GI: 114562396 Blast Desc: 2-nitropropane dioxygenase, NPD [Shewanella frigidimarina NCIMB 400] gi|114333689|gb|ABI71071.1| 2-nitropropane dioxygenase, NPD [Shewanella frigidimarina NCIMB
  misc_feature (14)..(529): NCBI GI: 6691657 Blast Desc: protein product [Moritella marina]
  misc_feature (69)..(507): PfaD family protein
  misc_feature (80)..(351): Pfam Id: PF03060 Pfam Desc: Nitronate monooxygenase / enoyl reductase
MLDINNNNIDWAWKVDNSAIQTQSSAIKAALMDLTNPVYVAKNGAQAGIANSISASGSEDVLAFAQKLNPEDLGDDAYKKQHGVKYAYHGGAMANGIASVELVVALGKAGFLCSFGAAGLVPDVIEESIKRIQAELPNGPYAVNLIHAPAEEALERGAVERFLKLGVKTVEASAYLGLTEHIVWYRVAGLSKNADGSVNIGHKVIAKVSRTEVGRRFMEPAPKKLLDKLLAQGKITQEQAELSQLVPMADDITAEADSGGHTDNRPFLTLLPTIIALRDEVQAKYNFSPALRVGAGGGIGTPEAALAAFNMGAAYIVLGSVNQACVEAGASEYTRKLLANVEMADVTMAPAADMFEMGVKLQVVKRGSMFAMRAKKLYDLYVAYDSIEDIPADERLKIEKQIFRSNLDDVWAGTESFFQQRDPEMLARAQSSPKRKMALIFRWYLGLSSRWSNIGEKGREMDYQIWAGPSLGAFNSWVKGTYLEDFTRRGAVDVALHMLKGAAYLQRVNMLKSQGVTFTTELASYRTDD

SEQ ID NO: 35 - DNA, 813 bp, Pseudoalteromonas sp.
  misc_feature: SGI cDNA ID NO. 277619
  misc_feature: PfaE gene
  misc_feature: Encodes the peptide sequence at SEQ ID NO 36
  misc_feature: Useful for modulating production of PUFA
atgaataataaaactgagcaaacagcttcaaaattaaaactaattggcaatgaaattcacctttggtcaatcgacccgacactaataacatgtgaaaatttacttaaaaaatataaaggtttattgactgaagatgagcgaataaaacaggaaagatatcgttttaataaagacaagcatagtgcacttataacccgtgcttttgttagagacttgctctcatattatgctgatgaaaaacctaatgactggcgctttagtaaaggtgaaaaagacaaaccagaaatcgtaaatccccctattccactgaggtttaatattagtcatacagacaaattgattatttgcgctgtaatgcttaatgatgatattggttgtgatgtagaaaatattaatagaagtacagatccactactaatcgccgagcgttttttctcaccaagtgaagtaactgaactattttcattaccagaacagcaacaacgtagccgattttttgattattggacattaaaagagtcatatataaaagcatggggattaggtttatctattcctttagctgatttcagctttgatatcgcgcaatcacaaagtagtcagcttaataacaatataaaactaagctttgccaagcataggaaggatgtgccagagatatggcaaagttggttaatttaccctaatgaatctcatagaatcgcaatatcagtaagagcaaaacacaataatcaacacattgattataaattaaggttttttaatagcgtaccattaaaaagctttaaagaaacaaactcttgctctttataa

SEQ ID NO: 36 - protein, 270 aa, Pseudoalteromonas sp.
  misc_feature: SGI Peptide ID NO. 277619
  misc_feature: PfaE polypeptide
  misc_feature: Useful for modulating production of PUFA
  misc_feature (5)..(245): NCBI GI: 119946351 Blast Desc: 4'-phosphopantetheinyl transferase [Psychromonas ingrahamii 37] gi|119864955|gb|ABM04432.1| 4'-phosphopantetheinyl transferase [Psychromonas ingrahamii 37]
  misc_feature (7)..(264): NCBI GI: 71282200 Blast Desc: 4-phosphopantetheinyl transferase [Colwellia psychrerythraea 34H] gi|71147940|gb|AAZ28413.1| 4-phosphopantetheinyl transferase [Colwellia psychrerythraea 34H]
  misc_feature (8)..(265): NCBI GI: 149911207 Blast Desc: 4-phosphopantetheinyl transferase [Moritella sp. PE36] gi|149805734|gb|EDM65732.1| 4-phosphopantetheinyl transferase [Moritella sp. PE36]
  misc_feature (8)..(259): NCBI GI: 119476927 Blast Desc: 4-phosphopantetheinyl transferase [marine gamma proteobacterium HTCC2143] gi|119449734|gb|EAW30971.1| 4-phosphopantetheinyl transferase [marine gamma proteobacterium
  misc_feature (11)..(265): NCBI GI: 112181143 Blast Desc: 4'-phosphopantetheinyl transferase [Moritella marina]
  misc_feature (11)..(238): NCBI GI: 218778906 Blast Desc: 4'-phosphopantetheinyl transferase [Desulfatibacillum alkenivorans AK-01] gi|218760290|gb|ACL02756.1| 4'-phosphopantetheinyl transferase [Desulfatibacillum AK-01]
  misc_feature (12)..(270): NCBI GI: 90408179 Blast Desc: 4'-phosphopantetheinyl transferase superfamily protein [Psychromonas sp. CNPT3] gi|90310709|gb|EAS38826.1| 4'-phosphopantetheinyl transferase superfamily protein sp. CNPT3]
  misc_feature (12)..(260): NCBI GI: 162453334 Blast Desc: 4'-phosphopantetheinyl transferase [Sorangium cellulosum 'So ce 56'] gi|161163916|emb|CAN95221.1| 4'-phosphopantetheinyl transferase [Sorangium cellulosum 'So ce
  misc_feature (12)..(261): NCBI GI: 108759439 Blast Desc: 4'-phosphopantetheinyl transferase [Myxococcus xanthus DK 1622] gi|108463319|gb|ABF88504.1| 4'-phosphopantetheinyl transferase [Myxococcus xanthus DK 1622]
  misc_feature (17)..(260): NCBI GI: 115378125 Blast Desc: MtaA [Stigmatella aurantiaca DW4/3-1] gi|310821268|ref|YP_003953626.1| 4'-phosphopantetheinyl transferase [Stigmatella aurantiaca DW4/3-1] MtaA [Stigmatella
  misc_feature (61)..(252): Pfam Id: PF01648 Pfam Desc: 4'-phosphopantetheinyl transferase superfamily
  misc_feature (124)..(187): Pfam Id: PF01648 Pfam Desc: 4'-phosphopantetheinyl transferase superfamily
MNNKTEQTASKLKLIGNEIHLWSIDPTLITCENLLKKYKGLLTEDERIKQERYRFNKDKHSALITRAFVRDLLSYYADEKPNDWRFSKGEKDKPEIVNPPIPLRFNISHTDKLIICAVMLNDDIGCDVENINRSTDPLLIAERFFSPSEVTELFSLPEQQQRSRFFDYWTLKESYIKAWGLGLSIPLADFSFDIAQSQSSQLNNNIKLSFAKHRKDVPEIWQSWLIYPNESHRIAISVRAKHNNQHIDYKLRFFNSVPLKSFKETNSCSL

SEQ ID NO: 37 - DNA, 7854 bp, Vibrio sp.
  misc_feature: SGI cDNA ID NO. 36935F
  misc_feature: Encodes the peptide sequence at SEQ ID NO 38
  misc_feature: Useful for modulating production of PUFA
atgagccaacctgaaacaaccaaacctgaatcgatcgacgatactcgtcttaacaaacgtcttaaagacatgccaattgcaatcgtcggtatggcgagtatgtttgctaactcccgttacttaaataagttctgggacttaatcagcgaaaaaatcgatgcgatcactgacgttccagagacccactggcgtccagaagactactacgatgcagacagaaccacacccgataagtcttactgtaagcgtggtggtttcattcctgaagttgatttcaacccaatggagtttggtctaccgccaaacatcttagaactgacggatacgtctcagctgctgtccctgatcgttgctaaagaagtacttgaagatgcaaaacttccagaaggctacgatcgcgacaaaattggtattacgctaggtgttggtggcggtcaaaaaatcgcacagagcttgaacgctcgtctgcaataccctgtactgaaaaaagtattcaagagcagcggtattagcgacgaagacagtgaaatgctgatcaagaagttccaagatcagtatatccactgggaagaaaactcgttcccaggctctcttggtaacgttatttcaggtcgtatcgctaaccgctttgaccttggtggcattaactgtgtggttgacgcagcgtgtgcgggctctctagccgccatgcgtatggcattgagcgagcttgtggaaggccgcagtgaaatgatgatcaccggtggtgtatgtaccgataactcaccaacaatgtacatgagcttctctaagacgccagcatttaccactaacgaaaccattcaaccgttcgacatcgactctaaaggtatgatgatcggtgaaggtatcggtatggttgcgcttaagcgtctagaagatgcagagcgtgatggcgacagaatttactctgtgatcaaaggcgtgggttcatcgtctgacggtaaatttaagagtatttatgctccacgcccagaaggccaagctaaagcgcttaaacgtgcttacgatgatgcgggttttgcaccacatacacttggtttacttgaagcgcacggtactggtaccgcggcaggtgatgttgcagaatttggcggtctaaattcagtattcagtgaagataacgaagagaagcagcacattgcgcttggctcggttaaatcacaaattggtcacactaaatcaacggcaggtacggctggtcttattaaagcggcgcttgcactgcaccataaagtgctaccgccaacgatcaacgtgtcagcgccaaaccctaaactcgacatcgagaattctccattttatctgaatactcaaacgagaccttggatgcagcgtgttgatggtactcctcgtcgtgctggtattagttcatttggttttggtggaaccaacttccacgtggtactagaagagtacactcaagaacatgctcgcggtgataaatatcgtcagcgtcaagttccacagtcgttcttattcagtgcagaatcacgtagcgcgttagttgctaacttgaatcaggctaaatcggctttgaacgatagcactgatctaagcaaactggctgcagactacgcactgcgtgaaatcgatgcatctcacgctcgtcttggtttagtcgctaatgatcacgcggatcttgaagcacagctgactaaagctatttcaatgatcgaagcgcaagataaagcacaatggcaactgccaaacggaacgactttccgtgaatctgcgttaacgggtgaccacaaaggaaatggcaaagttgccgccttgtttgcagggcagggttcacaatacctaaatatgggtcgcgagcttgcatgtcattacccagagatgcgtcagcagttagcaaaagcggatcaggtatttggtcagcataagaagactgcgttgtctcaggtacttttccctatccctacattcactgctgatgcaactaaagctcaagaagcgatattaaccaacactgcgaacgctcaaagtgcaatcggtacagtttctatgggtcagtttgagatcatgtctcaagctggttttaaagcggatatggttgcaggtcacagctttggtgaattaagcgcgctatgtgcgtctggtgtaatctctcaagatgattactaccaattggcatttgctcgtggcgatgcaatggcagcgacaccagaagaaggtgatagcggcacaatgtacgctgtgatcttagatgctgagaaattagcggatgttgaaagctgtattgctgcttttgaaggtgtaagcattgcaaattacaatgcgccaactcaactagttattgcaggcccaacagacgccgctaagcaagctgctgatgcgctaactgcgaaaggctttaaagcgatttcattgccagtgtctggtgcattccacactccattagttgctcatgctcaaaaaccgtttgcatctgcaatcgacaaagcatcatttactgcacctacgttaccactgtactcaaatgcgactggcaaactgcacggtaaagatggcaaggcaattaagaaagcctttaaacagcacatgctgcaatcagtacatttcagtgcgcaactggaagaaatgtataacgcaggcgctcgcgtgtttgttgagtttggaccaaagaacattctgaccaaactggtagagaaaacactagcagataaaagcgaagagctttgcacgatcagcattaacccaagccctaaaggggatagtgatcatcaattgcgcttagcagcggttcaactttgtgttgcgggtgtgtcactagacaacattgacccttaccaagctgatattgccgcgccagcagcaacgtcaccaatgaacatcaaattgaatgcaacgaactacatcagcccatcgactcgtaagaagatggatacgtcattggctactggtcaagtgactgagaagactgaaattgttgaagtgaaagttgaagtcgaaaagattgtggaaaaagaagtgatcaaaacagaagtagtagaagtgcctgctgccgttgcagcagagcaagtaccagcaatagcacaagttgctgcgcaagccgttactccggcaatgaacgcgcaggcggctaatgtgcaaactacgtcgtctgtatctgttgatgagtcgtcgttacaatcgttctttaacgcgcaacaacaagccgcggaagttcatcaacaattcttagccattcctcagcagtacggcgatacgtttaatacgctaatgtccgagcaagcgaaaatggcgacagcaggcgtttcagttccagaaagcctccaacgttcaatggacatgttccatcaacaccaagcagaaacgctgaaagctcacgcgcattatttagagacgcaagctcaaagcaacaatgccgcattaagcgctcttggctctcaaagcacagcgccagttgcggttcctgcttacacgccaacaattgttgcaccaccggttacagcacaggtcgctccgcaagttgctcctgttaaaacgcaagccgctccagtggttgcgcaagcacctaaatctgcagcgccagttgttcagcaacaagcgactccagcaatggcagctaagacttcagcacctgcaatcgttgctgaagcggctaaagctccagtagcaagtgcgccagttgcttcaactcaagctccttcaacggaagtgcaatctgctgatgctgaaaaagtaatgctagaagtggttgcagagaagacgggctatccaacagagatgttagctcttgatatggatatggaagctgatcttggtatcgattctatcaaacgtgttgagattcttggtacagttcaagatgaaatgccaaaccttccagagcttaacccagaagatttagcagagtgtcgcacgcttggtgaaattgttgcttacatgaacactaagatgcctgcagcaggtagtactccagttcaagctgtagcagcacaagtttctgctggcatagatgcggctcttgttcaaaaaacaatgctagaagtggttgctgagaaaactggttacccaacagagatgcttgatctagaaatggatatggaagcagaccttggtatcgactcaatcaaacgcgttgaaattctaggtacggttcaagatgagctaccaacactacctgagcttaaccctgaagatttagctgagtgtcgtacactgggtgaaattgtcgcctacatgaatagcaagctttctgcagctccagtatctgtagtcgcttctccagctgaagcacctgttgttagcggtttaagcgcagagacagtacaaaaaacaatgctagaagtggttgccgagaaaacgggttatccaacagaaatgcttgatctcgcaatggatatggaagcagaccttggtatcgactcaataaagcgcgtagaaattctaggtaccgttcaagacgaactaccaactcttcctgagcttaacccagaagacctagcagagtgtcgtactcttggcgaaatcgtttcttatatgaatagtaaaggcatgaacagcaaattatctgctgtatctgtatcggcacctgtagctcaacaagttcaggtagcttctacaggtgggcttgacgccgcgactgttcaaaagacaatgcttgaagtggttgcggaaaaaaccggttacccagtagagatgcttgatctagcgatggatatggaagcagaccttggtattgattctattaagcgtgtagagatccttggtacagttcaagacgaactacccactcttccagagctaaaccctgaagatctagcagagtgtcgtacactaggcgaaatcgttgactatatgaacagcaagctaagcgctcctgctgttgtagaagaagcggtaatcgcacaaacggaagctacgccagcagctaatggtctaaaccctgagcatgttcagtcaacgatgttagaagtggttgcagacaaaacaggttacccagcagaaatgctagacctagccatggatatggaagcagacctaggtatcgactcgattaagcgtgtagagatccttggtacggttcaagatcaactaccaactcttccagagctaaaccctgaagacctagcagagtgtcggacccttggcgaaatcgttacttacatgcaaggtaaactgtcagcctctgctccagtcgctaactctgaaaagcctgcaactcaaacagtaacacctatttctgaatctgcagaacttccaccacacaacgaggtagcgctaaaaaagctaccagcggtagataaactggtcgactgtttttcaaaagacgcttgtgttgtgatcaccgatgatggtcataatgcgggtgttctagcagaaaagctgactgctaacggcgttcaagttgctgtagtacgtagtccactatctgccgcgtcaccactaaacagtgaaatcgcaagctacacgctagaaagcattgatgatgaaggtgtaagcgctgttatcaattcaattgaagcagacttaaaaccttcaaataaagtgattgcaggttttgttcacctacaagcgttagttaactcgaaagatgagtcgtctaagtcaggcgttaacttaaatgtcgattctaaattgtcattttcaatcgcgttcttattcgctaagcacctaaacagccaacttaacactgtgtcaggtcgtagcgtgttcttcactctaagccgcattgatggcggttttggttacctagatgcagatcaattagtcaatgcagagctaaaccaagcggcactttcaggtttaacgaaaacgctgagccatgaatggtcaaacgtgttctgtcgtgcattggatgcaacgctagcgcttgatgctcgccacttagctgaagcgattacagcagagcttttcgacattgatacaaatacggttgaaattggttttacgtcgacggagaacagtgaagctgttgaaggtgaatcaggccgtgcaaccttgattgcagcagctcccggtgaggctttaacaaaaaatacagcagcaaaactggataagagcgataaagttcttgttactggtggtgctaaaggcgtaacgtttgagtgtgctttgactcttgctaagcagtgtcaatctcatttcatcttagcgggtcgtagtaagcatgttactgcaagcgagcttccacaatgggctcaaggtaagcaagaaagcgagctaaagcccgcagcaattgcgcacttgcaagcaacaggtgataagccaacgccaaagaaagtagaggccttaattaagccagtattaagcagcttagaaatcaatgctgcactagctgcatttaatgatgttggcgcaagcgctgaatacctaagccttgatgtatcgaatagcaaatctgtagtaaatacactggctaattttaacgacatcacaggcttgattcatggagcaggtgtactcgctgataagcatattcaggacaaaacgttagatgaactgaatatggtttacggaacgaaagtcggcggattagaagcggtacttagcggtattgatagcagcaaactgaaattggttgcgatgttctcttcagcggcaggtttctacggaaatattgggcaaagcgattacgcaatgtcgaatgaaatcttgaacaaagcagcgttgcaactatcagcacgtaaccctgaagcaaaagtaatgagcttcaactggggtccgtgggacggtggcatggtaaacgctgcactgaaaaaaatgttcgaagagcgcggtgtttacgtaattcctctacaagcgggtgcagaattgtttagctctcaactactaagcgaaaccggcattcaactacttgttggtacaagcatgcaaggcgctgaagaggaagcttctgtaaaaaagcttaatgcggagtctatgcatcttgcaaagagtccgctgaaaacaagcatcactgtgacacgtatccttgatccaaaggctctgcctttcatcaaggatcactgcattgccggtaatccagtgttaccgacagtgtgtgcaatccaatggatgcgtgagacagcgcagcagttgttagcggcgagcgttagcgttcgcaactacaagttgcttaaaggcgtaatctttgacactgatgaagcacaagaattaacagtgacactgtcacctgttgctaattctaaaaaggtggctaattctaatggtctaattaaagcgttgattagctgccaaggtcgaccacagtatcaagcggaattgcagattgctgaagcacaggtagcgggcgatgtgccagcttcattagttaagcattttgatgttagcaaaggctcaaaagttgccacagcagaaacgttgtacagtgacggaacgttatttcacgggccaacactgcaaggcattaaaacggtagagcgttttgatgacgaaggcttgttagcccaatgtgaaatgccaatggttgctgaaagtgattgcggttcgtttgttactagaaatggttttgctgatagccagccgtttgcagaagactacttgctacaggcgatgctggtttgggctcgtctaaagtacggctcagcgagtttaccttctgctattggtgaaatgatctgttacgcaccaatgcaatcaggtgacaaaggctatttagaacttgaagtgattaagagcaccgctcgctcactgcaagcgaacatttcgctatatcaccaagacggtcgattaagtacggtaatgaatggcgcgaaagtcaccatcagtaaaacgcttaatgatgccttcttagcgaatcaacctgagactaaatcagcagcgaaaaagacaaaaaagtctaaaacagctgagtctacaaaaacacaggagctatcctcatag

SEQ ID NO: 38 - protein, 2617 aa, Vibrio sp.
  misc_feature: SGI Peptide ID NO. 36935F
  misc_feature: Useful for modulating production of PUFA
  misc_feature (1)..(915): NCBI GI: 127513593 Blast Desc: beta-ketoacyl synthase [Shewanella loihica PV-4] gi|126638888|gb|ABO24531.1| beta-ketoacyl synthase [Shewanella loihica PV-4]
  misc_feature (1)..(921): NCBI GI: 160874571 Blast Desc: polyketide-type polyunsaturated fatty acid synthase PfaA [Shewanella baltica OS195] gi|300734233|ref|ZP_07067474.1| polyketide-type polyunsaturated fatty acid synthase PfaA baltica
  misc_feature (1)..(914): NCBI GI: 91793978 Blast Desc: beta-ketoacyl synthase [Shewanella denitrificans OS217] gi|91715980|gb|ABE55906.1| beta-ketoacyl synthase [Shewanella denitrificans OS217]
  misc_feature (1)..(921): NCBI GI: 206570564 Blast Desc: PfaA [Shewanella sp. BR-2]
  misc_feature (1)..(938): NCBI GI: 126173663 Blast Desc: beta-ketoacyl synthase [Shewanella baltica OS155] gi|125996868|gb|ABN60943.1| beta-ketoacyl synthase [Shewanella baltica OS155]
  misc_feature (1)..(926): NCBI GI: 114562399 Blast Desc: beta-ketoacyl synthase [Shewanella frigidimarina NCIMB 400] gi|114333692|gb|ABI71074.1| beta-ketoacyl synthase [Shewanella frigidimarina NCIMB 400]
  misc_feature (1)..(938): NCBI GI: 217974087 Blast Desc: polyketide-type polyunsaturated fatty acid synthase PfaA [Shewanella baltica OS223] gi|217499222|gb|ACK47415.1| polyketide-type polyunsaturated fatty acid synthase PfaA baltica
  misc_feature (1)..(926): NCBI GI: 149675716 Blast Desc: beta-ketoacyl synthase [Shewanella livingstonensis]
  misc_feature (1)..(921): NCBI GI: 152999951 Blast Desc: erythronolide synthase [Shewanella baltica OS185] gi|151364569|gb|ABS07569.1| Erythronolide synthase [Shewanella baltica OS185]
  misc_feature (1)..(938): NCBI GI: 120599574 Blast Desc: erythronolide synthase [Shewanella sp. W3-18-1] gi|120559667|gb|ABM25594.1| Erythronolide synthase [Shewanella sp. W3-18-1]
  misc_feature (24)..(301): Pfam Id: PF00109 Pfam Desc: Beta-ketoacyl synthase, N-terminal domain
  misc_feature (309)..(426): Pfam Id: PF02801 Pfam Desc: Beta-ketoacyl synthase, C-terminal domain
  misc_feature (599)..(929): Pfam Id: PF00698 Pfam Desc: Acyl transferase domain
  misc_feature (1238)..(1305): Pfam Id: PF00550 Pfam Desc: Phosphopantetheine attachment site/acyl carrier protein
  misc_feature (1337)..(1404): Pfam Id: PF00550 Pfam Desc: Phosphopantetheine attachment site/acyl carrier protein
  misc_feature (1437)..(1503): Pfam Id: PF00550 Pfam Desc: Phosphopantetheine attachment site/acyl carrier protein
  misc_feature (1543)..(1610): Pfam Id: PF00550 Pfam Desc: Phosphopantetheine attachment site/acyl carrier protein
  misc_feature (1646)..(1712): Pfam Id: PF00550 Pfam Desc: Phosphopantetheine attachment site/acyl carrier protein
  misc_feature (2014)..(2236): Pfam Id: PF08659 Pfam Desc: Ketoreductase domain (KR)
  misc_feature (2041)..(2066): Pfam Id: PF00106 Pfam Desc: short chain dehydrogenase
  misc_feature (2100)..(2218): Pfam Id: PF00106 Pfam Desc: short chain dehydrogenase
  misc_feature (2303)..(2578): Pfam Id: PF14765 Pfam Desc: polyketide synthase dehydratase domain (PS-DH)
MSQPETTKPESIDDTRLNKRLKDMPIAIVGMASMFANSRYLNKFWDLISEKIDAITDVPETHWRPEDYYDADRTTPDKSYCKRGGFIPEVDFNPMEFGLPPNILELTDTSQLLSLIVAKEVLEDAKLPEGYDRDKIGITLGVGGGQKIAQSLNARLQYPVLKKVFKSSGISDEDSEMLIKKFQDQYIHWEENSFPGSLGNVISGRIANRFDLGGINCVVDAACAGSLAAMRMALSELVEGRSEMMITGGVCTDNSPTMYMSFSKTPAFTTNETIQPFDIDSKGMMIGEGIGMVALKRLEDAERDGDRIYSVIKGVGSSSDGKFKSIYAPRPEGQAKALKRAYDDAGFAPHTLGLLEAHGTGTAAGDVAEFGGLNSVFSEDNEEKQHIALGSVKSQIGHTKSTAGTAGLIKAALALHHKVLPPTINVSAPNPKLDIENSPFYLNTQTRPWMQRVDGTPRRAGISSFGFGGTNFHVVLEEYTQEHARGDKYRQRQVPQSFLFSAESRSALVANLNQAKSALNDSTDLSKLAADYALREIDASHARLGLVANDHADLEAQLTKAISMIEAQDKAQWQLPNGTTFRESALTGDHKGNGKVAALFAGQGSQYLNMGRELACHYPEMRQQLAKADQVFGQHKKTALSQVLFPIPTFTADATKAQEAILTNTANAQSAIGTVSMGQFEIMSQAGFKADMVAGHSFGELSALCASGVISQDDYYQLAFARGDAMAATPEEGDSGTMYAVILDAEKLADVESCIAAFEGVSIANYNAPTQLVIAGPTDAAKQAADALTAKGFKAISLPVSGAFHTPLVAHAQKPFASAIDKASFTAPTLPLYSNATGKLHGKDGKAIKKAFKQHMLQSVHFSAQLEEMYNAGARVFVEFGPKNILTKLVEKTLADKSEELCTISINPSPKGDSDHQLRLAAVQLCVAGVSLDNIDPYQADIAAPAATSPMNIKLNATNYISPSTRKKMDTSLATGQVTEKTEIVEVKVEVEKIVEKEVIKTEVVEVPAAVAAEQVPAIAQVAAQAVTPAMNAQAANVQTTSSVSVDESSLQSFFNAQQQAAEVHQQFLAIPQQYGDTFNTLMSEQAKMATAGVSVPESLQRSMDMFHQHQAETLKAHAHYLETQAQSNNAALSALGSQSTAPVAVPAYTPTIVAPPVTAQVAPQVAPVKTQAAPVVAQAPKSAAPVVQQQATPAMAAKTSAPAIVAEAAKAPVASAPVASTQAPSTEVQSADAEKVMLEVVAEKTGYPTEMLALDMDMEADLGIDSIKRVEILGTVQDEMPNLPELNPEDLAECRTLGEIVAYMNTKMPAAGSTPVQAVAAQVSAGIDAALVQKTMLEVVAEKTGYPTEMLDLEMDMEADLGIDSIKRVEILGTVQDELPTLPELNPEDLAECRTLGEIVAYMNSKLSAAPVSVVASPAEAPVVSGLSAETVQKTMLEVVAEKTGYPTEMLDLAMDMEADLGIDSIKRVEILGTVQDELPTLPELNPEDLAECRTLGEIVSYMNSKGMNSKLSAVSVSAPVAQQVQVASTGGLDAATVQKTMLEVVAEKTGYPVEMLDLAMDMEADLGIDSIKRVEILGTVQDELPTLPELNPEDLAECRTLGEIVDYMNSKLSAPAVVEEAVIAQTEATPAANGLNPEHVQSTMLEVVADKTGYPAEMLDLAMDMEADLGIDSIKRVEILGTVQDQLPTLPELNPEDLAECRTLGEIVTYMQGKLSASAPVANSEKPATQTVTPISESAELPPHNEVALKKLPAVDKLVDCFSKDACVVITDDGHNAGVLAEKLTANGVQVAVVRSPLSAASPLNSEIASYTLESIDDEGVSAVINSIEADLKPSNKVIAGFVHLQALVNSKDESSKSGVNLNVDSKLSFSIAFLFAKHLNSQLNTVSGRSVFFTLSRIDGGFGYLDADQLVNAELNQAALSGLTKTLSHEWSNVFCRALDATLALDARHLAEAITAELFDIDTNTVEIGFTSTENSEAVEGESGRATLIAAAPGEALTKNTAAKLDKSDKVLVTGGAKGVTFECALTLAKQCQSHFILAGRSKHVTASELPQWAQGKQESELKPAAIAHLQATGDKPTPKKVEALIKPVLSSLEINAALAAFNDVGASAEYLSLDVSNSKSVVNTLANFNDITGLIHGAGVLADKHIQDKTLDELNMVYGTKVGGLEAVLSGIDSSKLKLVAMFSSAAGFYGNIGQSDYAMSNEILNKAALQLSARNPEAKVMSFNWGPWDGGMVNAALKKMFEERGVYVIPLQAGAELFSSQLLSETGIQLLVGTSMQGAEEEASVKKLNAESMHLAKSPLKTSITVTRILDPKALPFIKDHCIAGNPVLPTVCAIQWMRETAQQLLAASVSVRNYKLLKGVIFDTDEAQELTVTLSPVANSKKVANSNGLIKALISCQGRPQYQAELQIAEAQVAGDVPASLVKHFDVSKGSKVATAETLYSDGTLFHGPTLQGIKTVERFDDEGLLAQCEMPMVAESDCGSFVTRNGFADSQPFAEDYLLQAMLVWARLKYGSASLPSAIGEMICYAPMQSGDKGYLELEVIKSTARSLQANISLYHQDGRLSTVMNGAKVTISKTLNDAFLANQPETKSAAKKTKKSKTAESTKTQELSS

SEQ ID NO: 39 - DNA, 2076 bp, Vibrio sp.
  misc_feature: SGI cDNA ID NO. 36941
  misc_feature: PfaB gene
  misc_feature: Encodes the peptide sequence at SEQ ID NO 40
  misc_feature: Useful for modulating production of PUFA
gtgacggttccttctaataaagcgatgcctttgcgcatcgctcttttagctcagcctgcaaacgccgctgggctttctgccgacttgttatcttcacttcccgctgttaaagaaatagtggtcggtgatgatttcaatctatctataaatagtgctattgaagcgattactcaaggtcatgttgtcgagctaacgacggcgtcaggtaatgctgagatggaaaatagcatcttaatgctaagcgcgttgagtgctgctaaaagcaaaatccatcctcatgcttacttttctggtttttgtgaacacagtgcgacaaaagctgagagtgtcgaaaaagcactttctcatgcacgacgtcaacatgaagatctcagctatgactgtgattttgatgtaacgacttctgcacagcagtttgccgaatttttttttgtggttagcgcactatcaggtcgaacactggcaaatcgttattggtttacaaagccaaatagagcacgtgttgcgtcgctaacgtttaatcgcataagcgaaggctcaacaagtttaattttgactcaagcgacagggctacttcctgctaaaccattactttctgaagaaagagtaatgtttgtcgttagtggttcaaatgaaacggaacttagatccgctctagctcaactaaagctacagcttagtgatttgcctttaattgactctagtcagcctaaagcaattgaactgattgagttaatgcattctaaccttaagcagtatcagacatctggctctaaaaatgctgcttgtgctgatattgtcattcaagcgatatcggtagagtctgcgttaaaagagatctctgcgttagaaagttcactgagcaaggttatggctgaacaaagtcattacaaaacgcctgctggtagctgtttttcacccgctccaaacagcaaaggtggcgttacgtttgtttaccctggtgttggtactgtctatcctgggctgcttcgtgaatttcaccactatttcccacagctttttgctcggttagagcgtgaaggtgatctagaggaaatgctgcaggcgggtaaaacctatgctgatgagcctcaagagctgtcactgagtgaacttgccatcgcgggtgtaggcagtagctatattttgactcaattgttgtgtgaaaatttcgccgtgaagccggacttcgcgttaggctattccaaaggcgaagcatcaatgtgggcaagtttgggagtgtggaaaaacccgcacgcactgattgagatgactcaaaccagccctatcttcaccacagcgatttcaggggagctaactgcggtacgcgagaattggcaattaagcacgactgaacaaattacatggaatagctttgttgttcgcagtgatgcggcttctattgaagctcttttgcctgagttcccacgcgcttatctagctattgttcaaggtgatacttgtgttctagcgggttgtgaagaaacgtgccgagcacttcttaagaagttaggcaaacgtggaattccagctaaccgcgtaacagcgatgcatacgacaccagcttggagtcagcatgagcagatacgtgagttttacacgcaaccactgtttgatgaactgcctgagcatattcgtttcattagtgccgaccaaaatcgtccagttgatatcgacagtcaaagcattgcactttcaatcgctaatacgttttgttcgacattagattttacttcattaattcgcagtgcccgcagtcagggagctcgtctgtttatcgaagtaggggctgatcgtcagacaagtacgttaatcgacaagatcaatcgtactgatgaggtggctaacggctactgcactgttgcagcgaatgccaagggtggtgaagacatcacgacgctattgaaatgtattggccagttaattactcatcaaatccctctgtctgtttcaccacttcttgaagggttagagcagcagataaataacgcaaaatttgagcgtcttttatctgaggcgagccatcgctacgcgacagggaatcaagaaaataatcaccaaggagagccaatatga

SEQ ID NO: 40 - protein, 691 aa, Vibrio sp.
  misc_feature: SGI Peptide ID NO. 36941
  misc_feature: PfaB polypeptide
  misc_feature: Useful for modulating production of PUFA
  misc_feature (1)..(689): NCBI GI: 218710184 Blast Desc: omega-3 polyunsaturated fatty acid synthase PfaB [Vibrio splendidus LGP32] gi|218323203|emb|CAV19380.1| PfaB, omega-3 polyunsaturated fatty acid synthase [Vibrio splendidus
  misc_feature (1)..(689): NCBI GI: 84387724 Blast Desc: omega-3 polyunsaturated fatty acid synthase PfaB [Vibrio splendidus 12B01] gi|84377407|gb|EAP94274.1| omega-3 polyunsaturated fatty acid synthase PfaB [Vibrio splendidus
  misc_feature (1)..(689): NCBI GI: 86147636 Blast Desc: omega-3 polyunsaturated fatty acid synthase PfaB [Vibrio sp. MED222] gi|85834547|gb|EAQ52696.1| omega-3 polyunsaturated fatty acid synthase PfaB [Vibrio sp. MED222]
  misc_feature (1)..(691): NCBI GI: 15488032 Blast Desc: AF409100_8 omega-3 polyunsaturated fatty acid synthase PfaB [Photobacterium profundum SS9]
  misc_feature (1)..(691): NCBI GI: 90413868 Blast Desc: omega-3 polyunsaturated fatty acid synthase PfaB [Photobacterium profundum 3TCK] gi|90325052|gb|EAS41562.1| omega-3 polyunsaturated fatty acid synthase PfaB [Photobacterium
  misc_feature (4)..(661): NCBI GI: 163751052 Blast Desc: omega-3 polyunsaturated fatty acid synthase PfaB [Shewanella benthica KT99] gi|161329213|gb|EDQ00212.1| omega-3 polyunsaturated fatty acid synthase PfaB [Shewanella benthica
  misc_feature (4)..(661): NCBI GI: 2529419 Blast Desc: [Shewanella sp. SCRC-2738]
  misc_feature (4)..(661): NCBI GI: 294139972 Blast Desc: omega-3 polyunsaturated fatty acid synthase PfaB [Shewanella violacea DSS12] gi|293326441|dbj|BAJ01172.1| omega-3 polyunsaturated fatty acid synthase PfaB [Shewanella violacea
  misc_feature (9)..(691): NCBI GI: 54308652 Blast Desc: omega-3 polyunsaturated fatty acid synthase PfaB [Photobacterium profundum SS9] gi|46913081|emb|CAG19870.1| omega-3 polyunsaturated fatty acid synthase PfaB [Photobacterium
  misc_feature (9)..(689): NCBI GI: 212636305 Blast Desc: Omega-3 polyunsaturated fatty acid synthase PfaB [Shewanella piezotolerans WP3] gi|212557789|gb|ACJ30243.1| Omega-3 polyunsaturated fatty acid synthase PfaB [Shewanella WP3]
  misc_feature (313)..(611): Pfam Id: PF00698 Pfam Desc: Acyl transferase domain
MTVPSNKAMPLRIALLAQPANAAGLSADLLSSLPAVKEIVVGDDFNLSINSAIEAITQGHVVELTTASGNAEMENSILMLSALSAAKSKIHPHAYFSGFCEHSATKAESVEKALSHARRQHEDLSYDCDFDVTTSAQQFAEFFFVVSALSGRTLANRYWFTKPNRARVASLTFNRISEGSTSLILTQATGLLPAKPLLSEERVMFVVSGSNETELRSALAQLKLQLSDLPLIDSSQPKAIELIELMHSNLKQYQTSGSKNAACADIVIQAISVESALKEISALESSLSKVMAEQSHYKTPAGSCFSPAPNSKGGVTFVYPGVGTVYPGLLREFHHYFPQLFARLEREGDLEEMLQAGKTYADEPQELSLSELAIAGVGSSYILTQLLCENFAVKPDFALGYSKGEASMWASLGVWKNPHALIEMTQTSPIFTTAISGELTAVRENWQLSTTEQITWNSFVVRSDAASIEALLPEFPRAYLAIVQGDTCVLAGCEETCRALLKKLGKRGIPANRVTAMHTTPAWSQHEQIREFYTQPLFDELPEHIRFISADQNRPVDIDSQSIALSIANTFCSTLDFTSLIRSARSQGARLFIEVGADRQTSTLIDKINRTDEVANGYCTVAANAKGGEDITTLLKCIGQLITHQIPLSVSPLLEGLEQQINNAKFERLLSEASHRYATGNQENNHQGEPI

SEQ ID NO: 41 - DNA, 5922 bp, Vibrio sp.
  misc_feature: SGI cDNA ID NO. 36919
  misc_feature: PfaC gene
  misc_feature: Encodes the peptide sequence at SEQ ID NO 42
  misc_feature: Useful for modulating production of PUFA
atgagttctcagaaagataatgtgaaatgcaataagattgcaattgtaggtattgcaaatcaatacccgcaatctgatacgccaaaagacttttggcaaaatctactcgataaaaaagactctcgaaccacgctaagtgcagaaaaacttggcgcaacaccaaatgattaccaaggtgttcaaggtgagtctgaccgtttttattgcgataaaggcggctacattgaaaacttcaactttgatagttcaggttaccgcgtaacggaagagtcgttccaaggtgttgatcaaagctttttatgggcgctggatacaagccgtaaagcattagtcgatgcaggcgttaatcttagtgaggatgtgctagaacgaacgggtgtcattatgggtgcgctatcgttcccaacgacacgctcgaacgatctgtttttgcctatgtaccactcagtggtggaaaaggcgttgaagacgaagttatcaaatgaaaacttccagctattgccaaccaatgaacagcctcagccactcaatgccatcaacggtgccgcagcgcataacgcgtcgaaactggttgctgacgctttgggtcttggtaatgttcagttaagccttgatgcggcctgtgctagctcggtatattcattgaaacttgcttgtgattacctcaacacaggtaaagctgacatgatgttagctggtgcggtgtcaggcgcagatccattctttattaacatgggcttctcaatattccatgcttatccagatcatggtgtttcggttccatttgatagcaacagtaaaggtctatttgctggtgaaggcgctggcgtattagttctgaaacgtcttgcggatgctgaacgtgatggcgataatatttatgccgttgttagcggtattggtttatcaaacgatggccgtggccaattcgtattgagcccaaacagtaaagggcaagttcaagcatttgaacgtgcttacgaagcttcgaatctaacaccagaaagtattgaagtgatcgagtgtcatgcgacgggtacgccactaggcgataaagttgagctgacatcaatggagcgcttctttgccgataagcttcaaggttcaaacgtgccaatgattggttcagcgaaatcgaatcttggacacttgcttacggctgcgggaatgccagggatcatgaaaatgatctttgcaatgaaagagggcgtgctaccgccaagtatcaatcttgatacgcctctatcttctccagatgggttatttggtaataaaactctgcctaaagaagttcaggcgtggccagacaaagcgggtaatagtgagcgttgttcgggtgtctcggtatttggttttggtggctgtaatgcgcacctattgctagaggcttactcgaagaacagcagcgtttcaactcaagatatctctacatcaacgggtcgagcagcaacgtcagcgctgaagatcacagggcttgcgtctcattttggttctctaaaaagtgtgtgtgagtttgatagcgcaattaaatccaatgcaaatgccttcattgaactgccgaagaaacgttggaaagggttagaccaacacttagagttgttaagtaagcttggtttagatggcgtcccaagtggcgcgtacattgatcagttcgacctcgatttcctacgcttcaaagtaccgccaaatgaagatgatcgtttaatctctcaacagctgttattgatgaaagttgccgatgaagcgattcgtgacgccaagttagaagcagggaagaaagtcgctgttttagtggcgatggaaacagaactagaaatgcaccagttccgtggccgtgtgaatttgcatagccagcttgctgatagccttgaaaatatgggcattgatttaacagaagccgaatataaagcgctagaaaccattgcgatggacagtgtaatggatgcggcgaagctaaatcagtacaccagtttcattggtaatatcatggcgtctagaatctcgtctctttgggatttcaatggccctgcttttaccatatctgcggcggagcaatcggttgcaaggtgtgttgatgtcgcagaaaacttgatgtcgcaagagtcaatcgatgcggttgttatcgcagccgttgacctcagtggcagtgctgagcatgttctactgagaaacagtgttacgcctgtcgctctaagctcaacagacagcggatggaaagttggcgaaggtgcaggggcggttgtccttgttgataaagcacatgcagagtcaactcagtgtcaggcttatggtgaaatcagtgcgttagcctttggggcgagtgcacgagaacatgttgtcactgatgaattattgacacgcataggcattagctcaaacgaaatttccttgttagagctaaacgaagcggcagaaaatcaggcggcaacgcaattgccaagcacgttaacgacagcaatgcctattcaagctagcgagcgagtaggtcactgttcttcagcttcaggtatgtcgagtcttattcatggcttactgaaccttaacggtcaggctagcctattgaaaagagcggttgtggctaacatcagtgaaggtcagtgttcgcagctactgttaactcagtcaaatactgaatctcaagcattgaacattcgtttaagcagcgaactgcccactgacagtaagcgtcaattagttaagtcagtagctctgggtggacgtgatatttatcaacacatcacggaaacaccgttagctgaattaaatcaaatccaacaaaagtcagcaggtaaaccagcgaagagacaagcagcggttgcgacattagcgcaatcgaatattgtgactctagaacaagctaaagcgccactggtagagaaggcaaaagtagagacaccaacgtttacggcgacacaacctttactttcttctgcaactatttcttctgaagctttggcgacgacttcgccgaattcgaatacaggtaatcacagcaatatgactacagtcctatccgctaaagagaacgcaccacaggtttcagcgttcaataaaaatcaacaattgacccaagaagtgcacaaagcatttctgaagacccgcgctcaaggtcttcaaatcgccgatgcactattaaaggcgcaattaaatgccgttacaacgggtattgataatgcccagttaagcgtaagcggtagcgttcaaacattggagattcaaaacggtgtggctagcgcacctgtaacgcaacctgtaacgcaacctgtaaatgcattcgctaatgtagaagctgcttcgccagtgaagcctgtgcttaagccatgcatctggaactatgatgatttagtcgagtatgccgaaggtgacatcgcgaatgtatttggtcctgattacgcgatcatcgacagttattctcgccgtgttaggctgccaaccactgattaccttttggtatctcgtgttaccaaactgaacgcaacagtcaacgaatacaagccaagcacaatgacgacggaatacgacattcctgttgatgcgccttatcttgttgatggtcaaatcccttgggcagtcgccgtagaatcaggtcaatgtgacttaatgctgatcagctacttaggcattgattttgaaaacaaaggtgagcgcgtatatcgtctgcttgattgtacgctaaccttcttaggcgaccttcctcgcggcggtgatacgctacgttatgatatttcaatcaatagctttgctcgcaatggcgatactctgctgttcttcttctcgtacgaatgtttcgttggcgataagatgatcctgaaaatggataacggctgtgcgggcttcttcactgatgaagagctagctgacggcaaaggcgtgattcacactgaagatgaaatcaaagcacgtaaactggcgaccaaacagcgttttgatccaatcctacattgccctaaaacgcaatttgataaccaatctctacgtcatttgcttactgcaaatattgcagaatgttttggcccaactcaccaatcggatcgtcatcagccttcactctgctttagctcagagaagtttatgatgattgaaaaggttagccgtgttgaaccgcaaggtggtacatggggacttggtttaattgaaggtcacaagcagctagaacctgagcattggtacttcccatgtcacttcaaagatgattcagtaatggctggttctttaatggcagaaggctgtggacagctgctgcagttctacatgatgcatttaggtatgcacacgctagtgcagaacggtcgtttccaaccactagagaatgcgccgcagcaagtacgctgtcgtggtcaagttctccctcaatctgctgaactaacgtaccgtatggaagtgaccgaaattggtttgagcccgcgtccatacgcgaaagcaaacattgatattctacttaacggtaaagtcattgttgatttccaaaacctgggtgtgatgattcgtgaagacgaagagtgtactcgttacattggttctggtgattacgtcgtgacggatgaaacaacgattccttacgcaaaaacgacttcaactgtttctagttcagtaaaagcggttgttgcagataaatcggtaagtcaacaagcgtcagaaaatgcaccactaatggcgcagattcctgatttagaaacagcgactaacaaaggtgtaatccctctgcagcatgttgaagctccagtaactccagattacccgaaccgtacgcctgataccgttccatttacgccgtatcatatgtttgagtttgccacgggcgatatcgagaagtgtttcggccctgatttctcaatctaccgaggcatgatcccaccacgtaccccgtgtggcgatctgcaactgacaactcgtgttgttgatatcaaaggtaagcgtggtgactttaagaagccgtcttcgtgtattgcagaatatgaagtaccagcgaatgcttggtattacgacgaaaacagccatgaatcactgatgccgtactcggtattaatggaaatctcacttcagccaaatggtttcatttctggctacatgggcacaactcttggtttcccaggtgaagagctattcttccgtaaccttgatggtagcggtaaaatgctacgtaacgttgatttacgcggcaaaaccatcaccaacgactcacgtctactttcaacggtaatgatgggtactaacattgttcaaagttttagcttcgagctaagtactgatggcgtaccattctatgaaggaacagctgtatttggttacttcaaaggtgcagccctaaaagatcaactgggtcttgataacggtaaggtcacacaaccttggcatgtcgataataatagaacacctgacgttagcattgatcttctggacaagactagccgttatttcaatgctccaatatcagcaacgagcgttgaacaaacacactacaaacttgctggtggtcgtttgaactttatcgataacgttcaaatcacaagcgatggtggtaagtctgggcttggctacttatacgccgagcgtactatcgaccctagcgattggtttttccagttccatttccatcaagatccagtaatgccgggatctctaggcgttgaagcgatcattgagctaatgcaaacctacgcgttgaataaagatttaggtgcaggtttccgtaatccgaagtttggtcaaattcaatctgaagtgaagtggaagtaccgtggtcagattaacccgttaaacaaacagatgtctcttgatgtacacatcacagctatcaaagatgaagatggtaagaaaatcattgttggtgacgcgaacctaagcaaagacgggcttcgtatctacgaactaaaagacatcgcaatttgtcttcaagaagcagacagcattgaagaagcgtaa

SEQ ID NO: 42 - protein, 1973 aa, Vibrio sp.
  misc_feature: SGI Peptide ID NO. 36919
  misc_feature: PfaC polypeptide
  misc_feature: Useful for modulating production of PUFA
  misc_feature (1)..(1967): NCBI GI: 114562397 Blast Desc: Beta-hydroxyacyl-(acyl-carrier-protein) dehydratase, FabA/FabZ [Shewanella frigidimarina NCIMB 400] gi|114333690|gb|ABI71072.1| dehydratase, FabA/FabZ [Shewanella
  misc_feature (2)..(1967): NCBI GI: 163751051 Blast Desc: omega-3 polyunsaturated fatty acid synthase PfaC [Shewanella benthica KT99] gi|161329212|gb|EDQ00211.1| omega-3 polyunsaturated fatty acid synthase PfaC [Shewanella benthica
  misc_feature (4)..(1967): NCBI GI: 114048227 Blast Desc: Beta-hydroxyacyl-(acyl-carrier-protein) dehydratase, FabA/FabZ [Shewanella sp. MR-7] gi|113889669|gb|ABI43720.1| Beta-hydroxyacyl-(acyl-carrier-protein) dehydratase, FabA/FabZ
  misc_feature (9)..(1967): NCBI GI: 91793980 Blast Desc: Beta-hydroxyacyl-(acyl-carrier-protein) dehydratase, FabA/FabZ [Shewanella denitrificans OS217] gi|91715982|gb|ABE55908.1| dehydratase, FabA/FabZ [Shewanella
  misc_feature (11)..(286): Pfam Id: PF00109 Pfam Desc: Beta-ketoacyl synthase, N-terminal domain
  misc_feature (12)..(1967): NCBI GI: 127513595 Blast Desc: Beta-hydroxyacyl-(acyl-carrier-protein) dehydratase, FabA/FabZ [Shewanella loihica PV-4] gi|126638890|gb|ABO24533.1| Beta-hydroxyacyl-(acyl-carrier-protein) dehydratase, FabA/FabZ
  misc_feature (12)..(1967): NCBI GI: 24373169 Blast Desc: beta keto-acyl synthase [Shewanella oneidensis MR-1] gi|24347380|gb|AAN54656.1|AE015606_2 multi-domain beta-ketoacyl synthase [Shewanella oneidensis MR-1]
  misc_feature (12)..(1967): NCBI GI: 117921283 Blast Desc: Beta-hydroxyacyl-(acyl-carrier-protein) dehydratase, FabA/FabZ [Shewanella sp. ANA-3] gi|117613615|gb|ABK49069.1| Beta-hydroxyacyl-(acyl-carrier-protein) dehydratase, FabA/FabZ
  misc_feature (12)..(1967): NCBI GI: 113971003 Blast Desc: Beta-hydroxyacyl-(acyl-carrier-protein) dehydratase, FabA/FabZ [Shewanella sp. MR-4] gi|113885687|gb|ABI39739.1| Beta-hydroxyacyl-(acyl-carrier-protein) dehydratase, FabA/FabZ
  misc_feature (18)..(1967): NCBI GI: 119774250 Blast Desc: omega-3 polyunsaturated fatty acid synthase PfaC [Shewanella amazonensis SB2B] gi|119766750|gb|ABL99320.1| omega-3 polyunsaturated fatty acid synthase PfaC [Shewanella amazonensis
  misc_feature (129)..(1967): NCBI GI: 219806608 Blast Desc: Beta-hydroxyacyl-(acyl-carrier-protein) dehydratase, FabA/FabZ [Shewanella livingstonensis]
  misc_feature (294)..(412): Pfam Id: PF02801 Pfam Desc: Beta-ketoacyl synthase, C-terminal domain
  misc_feature (489)..(755): Pfam Id: PF00109 Pfam Desc: Beta-ketoacyl synthase, N-terminal domain
  misc_feature (1355)..(1488): Pfam Id: PF07977 Pfam Desc: FabA-like domain
  misc_feature (1826)..(1957): Pfam Id: PF07977 Pfam Desc: FabA-like domain
MSSQKDNVKCNKIAIVGIANQYPQSDTPKDFWQNLLDKKDSRTTLSAEKLGATPNDYQGVQGESDRFYCDKGGYIENFNFDSSGYRVTEESFQGVDQSFLWALDTSRKALVDAGVNLSEDVLERTGVIMGALSFPTTRSNDLFLPMYHSVVEKALKTKLSNENFQLLPTNEQPQPLNAINGAAAHNASKLVADALGLGNVQLSLDAACASSVYSLKLACDYLNTGKADMMLAGAVSGADPFFINMGFSIFHAYPDHGVSVPFDSNSKGLFAGEGAGVLVLKRLADAERDGDNIYAVVSGIGLSNDGRGQFVLSPNSKGQVQAFERAYEASNLTPESIEVIECHATGTPLGDKVELTSMERFFADKLQGSNVPMIGSAKSNLGHLLTAAGMPGIMKMIFAMKEGVLPPSINLDTPLSSPDGLFGNKTLPKEVQAWPDKAGNSERCSGVSVFGFGGCNAHLLLEAYSKNSSVSTQDISTSTGRAATSALKITGLASHFGSLKSVCEFDSAIKSNANAFIELPKKRWKGLDQHLELLSKLGLDGVPSGAYIDQFDLDFLRFKVPPNEDDRLISQQLLLMKVADEAIRDAKLEAGKKVAVLVAMETELEMHQFRGRVNLHSQLADSLENMGIDLTEAEYKALETIAMDSVMDAAKLNQYTSFIGNIMASRISSLWDFNGPAFTISAAEQSVARCVDVAENLMSQESIDAVVIAAVDLSGSAEHVLLRNSVTPVALSSTDSGWKVGEGAGAVVLVDKAHAESTQCQAYGEISALAFGASAREHVVTDELLTRIGISSNEISLLELNEAAENQAATQLPSTLTTAMPIQASERVGHCSSASGMSSLIHGLLNLNGQASLLKRAVVANISEGQCSQLLLTQSNTESQALNIRLSSELPTDSKRQLVKSVALGGRDIYQHITETPLAELNQIQQKSAGKPAKRQAAVATLAQSNIVTLEQAKAPLVEKAKVETPTFTATQPLLSSATISSEALATTSPNSNTGNHSNMTTVLSAKENAPQVSAFNKNQQLTQEVHKAFLKTRAQGLQIADALLKAQLNAVTTGIDNAQLSVSGSVQTLEIQNGVASAPVTQPVTQPVNAFANVEAASPVKPVLKPCIWNYDDLVEYAEGDIANVFGPDYAIIDSYSRRVRLPTTDYLLVSRVTKLNATVNEYKPSTMTTEYDIPVDAPYLVDGQIPWAVAVESGQCDLMLISYLGIDFENKGERVYRLLDCTLTFLGDLPRGGDTLRYDISINSFARNGDTLLFFFSYECFVGDKMILKMDNGCAGFFTDEELADGKGVIHTEDEIKARKLATKQRFDPILHCPKTQFDNQSLRHLLTANIAECFGPTHQSDRHQPSLCFSSEKFMMIEKVSRVEPQGGTWGLGLIEGHKQLEPEHWYFPCHFKDDSVMAGSLMAEGCGQLLQFYMMHLGMHTLVQNGRFQPLENAPQQVRCRGQVLPQSAELTYRMEVTEIGLSPRPYAKANIDILLNGKVIVDFQNLGVMIREDEECTRYIGSGDYVVTDETTIPYAKTTSTVSSSVKAVVADKSVSQQASENAPLMAQIPDLETATNKGVIPLQHVEAPVTPDYPNRTPDTVPFTPYHMFEFATGDIEKCFGPDFSIYRGMIPPRTPCGDLQLTTRVVDIKGKRGDFKKPSSCIAEYEVPANAWYYDENSHESLMPYSVLMEISLQPNGFISGYMGTTLGFPGEELFFRNLDGSGKMLRNVDLRGKTITNDSRLLSTVMMGTNIVQSFSFELSTDGVPFYEGTAVFGYFKGAALKDQLGLDNGKVTQPWHVDNNRTPDVSIDLLDKTSRYFNAPISATSVEQTHYKLAGGRLNFIDNVQITSDGGKSGLGYLYAERTIDPSDWFFQFHFHQDPVMPGSLGVEAIIELMQTYALNKDLGAGFRNPKFGQIQSEVKWKYRGQINPLNKQMSLDVHITAIKDEDGKKIIVGDANLSKDGLRIYELKDIAICLQEADSIEEA

SEQ ID NO: 43 - DNA, 1638 bp, Vibrio sp.
  misc_feature: SGI cDNA ID NO. 36920
  misc_feature: PfaD gene
  misc_feature: Encodes the peptide sequence at SEQ ID NO 44
  misc_feature: Useful for modulating production of PUFA
atgacgacacaaacaacaatgaataacgaaaaactttctccgtggccttggcagattgaagagcgcacaacgcattttgatacagcagcgatggcgacagcacttaaagacatgagtcttggctgctacgttgttaatcacccagaaaaaggcttaggcgttagccagcaagctgaaattgcatcaggtgattctgcaagctctgtaaatacacacccagtgagtgcatttgcgccagctcttggcacacaaagcttaggtgatgaagacttccgtcgctgtcacggtgttaagtacgcgtattacgcaggtgccatggcaaacggcatctcttctgaagagcttgtaattgcacttggtaaagcgggtattctatgttcttttggcgcagcggggcttattccttcgcgtgtagaacaggcgattaaccgtattcaagcggcactgccaaacggcccttacatgtttaacttgatccacagtccaagtgaacctgcactagagcgtggtagtgtagagctgtttttaaaacatggcgtccacacagttgaagcttccgctttcttgggattaacacctcaaatcgttcaatatcgcgctgcaggtcttagccgtgatgcaaaaggcgaaatccaaatcgctaacaaagtgatcgcgaaagtaagccgtactgaagtggcaagtaagttcatgcaaccagcaccaattaagatgttacaagggttggttgacgaaggtcgtattaccgcagagcaaatggaattagcacagcttgttcctatggcggacgacattacagcagaagcagactctggtggtcatacggataaccgtccactagtgactcttcttccgacgattctagcgcttaaagataagattcaagcgcaatacaaatttaagacaccacttcgcgtaggttgtggcggtggtgttggtactcctgatgccgcactagcgacatttaacatgggtgctgcctacattgtgacgggttcaattaaccaagcatgtgtagaagccggggcgagtgagcatacacgcaaactgctttcaacgactgaaatggctgacgtgaccatggcaccagcagcggacatgtttgaaatgggcgtgaagcttcaggttgttaaacgcggaaccttgtttccaatgcgagcaaacaagctgtatgagatctacacacgttacgactcaattgaagccattccggttgcagagcgtgagaagctagagaaacaagttttccgttcaacgcttgatgacatttgggcggggactgttgcacactttaacgaacgtgaccctaaacagattgagcgtgcggaaggcaaccctaagcgtaaaatggcactgattttccgttggtatcttggtttatcaagccgttggtctaatacgggtgaacaagggcgtgaaatggattaccaagtgtgggccggcccggctcttggcgcattcaacgaatgggcgaaagatagctatctagatgattacactcaacgtaatgcggttgatttagcgaagcacttaatgcacggggccgcttatctcgctcgtgttaacttgttaacctctcaaggaataaagttagcaccagagttagcacgttggactccaagccaacgaatggcttag

SEQ ID NO: 44 - protein, 545 aa, Vibrio sp.
  misc_feature: SGI Peptide ID NO. 36920
  misc_feature: PfaD polypeptide
  misc_feature: Useful for modulating production of PUFA
  misc_feature (1)..(545): NCBI GI: 218710186 Blast Desc: omega-3 polyunsaturated fatty acid synthase PfaD [Vibrio splendidus LGP32] gi|218323205|emb|CAV19382.1| PfaD, omega-3 polyunsaturated fatty acid synthase [Vibrio splendidus
  misc_feature (1)..(545): NCBI GI: 84387722 Blast Desc: omega-3 polyunsaturated fatty acid synthase PfaD [Vibrio splendidus 12B01] gi|84377405|gb|EAP94272.1| omega-3 polyunsaturated fatty acid synthase PfaD [Vibrio splendidus
  misc_feature (1)..(545): NCBI GI: 86147638 Blast Desc: omega-3 polyunsaturated fatty acid synthase PfaD [Vibrio sp. MED222] gi|85834549|gb|EAQ52698.1| omega-3 polyunsaturated fatty acid synthase PfaD [Vibrio sp. MED222]
  misc_feature (1)..(544): NCBI GI: 90413866 Blast Desc: omega-3 polyunsaturated fatty acid synthase PfaD [Photobacterium profundum 3TCK] gi|90325050|gb|EAS41560.1| omega-3 polyunsaturated fatty acid synthase PfaD [Photobacterium
  misc_feature (1)..(544): NCBI GI: 54308650 Blast Desc: omega-3 polyunsaturated fatty acid synthase PfaD [Photobacterium profundum SS9] gi|15488034|gb|AAL01063.1|AF409100_10 omega-3 polyunsaturated
  misc_feature (1)..(540): NCBI GI: 219806610 Blast Desc: omega-3 polyunsaturated fatty acid synthase PfaD [Shewanella livingstonensis]
  misc_feature (1)..(540): NCBI GI: 114562396 Blast Desc: 2-nitropropane dioxygenase, NPD [Shewanella frigidimarina NCIMB 400] gi|114333689|gb|ABI71071.1| 2-nitropropane dioxygenase, NPD [Shewanella frigidimarina NCIMB
  misc_feature (6)..(545): NCBI GI: 212636308 Blast Desc: Polyunsaturated fatty acid synthase PfaD [Shewanella piezotolerans WP3] gi|212557792|gb|ACJ30246.1| Polyunsaturated fatty acid synthase PfaD [Shewanella piezotolerans WP3]
  misc_feature (6)..(545): NCBI GI: 170725781 Blast Desc: PfaD family protein [Shewanella woodyi ATCC 51908] gi|169811128|gb|ACA85712.1| PfaD family protein [Shewanella woodyi ATCC 51908]
  misc_feature (9)..(545): NCBI GI: 163751050 Blast Desc: KT99_04837 [Shewanella benthica KT99] gi|161329211|gb|EDQ00210.1| KT99_04837 [Shewanella benthica KT99]
  misc_feature (83)..(521): PfaD family protein
  misc_feature (93)..(366): Pfam Id: PF03060 Pfam Desc: Nitronate monooxygenase / enoyl reductase
MTTQTTMNNEKLSPWPWQIEERTTHFDTAAMATALKDMSLGCYVVNHPEKGLGVSQQAEIASGDSASSVNTHPVSAFAPALGTQSLGDEDFRRCHGVKYAYYAGAMANGISSEELVIALGKAGILCSFGAAGLIPSRVEQAINRIQAALPNGPYMFNLIHSPSEPALERGSVELFLKHGVHTVEASAFLGLTPQIVQYRAAGLSRDAKGEIQIANKVIAKVSRTEVASKFMQPAPIKMLQGLVDEGRITAEQMELAQLVPMADDITAEADSGGHTDNRPLVTLLPTILALKDKIQAQYKFKTPLRVGCGGGVGTPDAALATFNMGAAYIVTGSINQACVEAGASEHTRKLLSTTEMADVTMAPAADMFEMGVKLQVVKRGTLFPMRANKLYEIYTRYDSIEAIPVAEREKLEKQVFRSTLDDIWAGTVAHFNERDPKQIERAEGNPKRKMALIFRWYLGLSSRWSNTGEQGREMDYQVWAGPALGAFNEWAKDSYLDDYTQRNAVDLAKHLMHGAAYLARVNLLTSQGIKLAPELARWTPSQRMA

SEQ ID NO: 45 - DNA, 840 bp, Vibrio sp.
  misc_feature: SGI cDNA ID NO. 42334
  misc_feature: Encodes the peptide sequence at SEQ ID NO 46
  misc_feature: Useful for modulating production of PUFA
atgctagaaagtcacttagatgttgatttatggttgtgccctctcggtgggctcaacgaatgcccaaaacacattactacactcaaaaagagattaaccaacgacgaagtgacaaaagtagaacgctatcgacaggctaaagcacaattgaaagcactgtatactcgtcattatttacgctcagttttgtctcggtattctatgaacaacccagagtcttggcggtttgattacggagaaaagggaaagccttctctttgttcaacccaatttgctcaaacgggtatcgttttcaacattagtcatagtcaggagcatctcgtcattgctgtttgcaaaagcgttgaccaaggtattttgttgggtgtggacattgagcatagtcgtaaaaataccgacattcacgccatcatgaagcattactttacccatgaagagatagccgttttagaaacgttaaatgacgaagctcaaagagagcgattcttcgatttatgggtgttaaaagagtcttacattaaggcgacggggcaagggttagcgacatcattaaagagcttttattttgacttcaagaatcaagaacagcaccttcataatgtggccaacgaagcacccttgattggctatccaagccaagttcgcctctttaagggcatatccatccattcccatgaatcaactcaagcgtgtaacgttgcaaaggatcggagcccgaccggctggcaatgtttattaggaaagttaaatgaaacgtttcggtttgcggtaagcgttggagggactgataaagcgatagttctcaggatcaaagccattgacactgattcattacgttga

SEQ ID NO: 46 - protein, 279 aa, Vibrio sp.
  misc_feature: SGI Peptide ID NO. 42334
  misc_feature: PfaE polypeptide
  misc_feature: Useful for modulating production of PUFA
  misc_feature (1)..(261): NCBI GI: 212636300 Blast Desc: 4'-phosphopantetheinyl transferase [Shewanella piezotolerans WP3] gi|212557784|gb|ACJ30238.1| 4'-phosphopantetheinyl transferase [Shewanella piezotolerans WP3]
  misc_feature (6)..(260): NCBI GI: 206570562 Blast Desc: 4'-phosphopantetheinyl transferase [Shewanella sp. BR-2]
  misc_feature (6)..(267): NCBI GI: 300734235 Blast Desc: 4'-phosphopantetheinyl transferase [Shewanella baltica OS678] gi|299814659|gb|EFI81903.1| 4'-phosphopantetheinyl transferase [Shewanella baltica OS678]
  misc_feature (6)..(267): NCBI GI: 160874573 Blast Desc: 4'-phosphopantetheinyl transferase [Shewanella baltica OS195] gi|160860095|gb|ABX48629.1| 4'-phosphopantetheinyl transferase [Shewanella baltica OS195]
  misc_feature (6)..(263): NCBI GI: 124545159 Blast Desc: 4'-phosphopantetheinyl transferase [Shewanella putrefaciens 200] gi|124511346|gb|EAY55411.1| 4'-phosphopantetheinyl transferase [Shewanella putrefaciens 200]
  misc_feature (7)..(259): NCBI GI: 170727642 Blast Desc: 4'-phosphopantetheinyl transferase [Shewanella woodyi ATCC 51908] gi|169812989|gb|ACA87573.1| 4'-phosphopantetheinyl transferase [Shewanella woodyi ATCC 51908]
  misc_feature (8)..(261): NCBI GI: 218710182 Blast Desc: 4'-phosphopantetheinyl transferase [Vibrio splendidus LGP32] gi|218323201|emb|CAV19378.1| 4'-phosphopantetheinyl transferase [Vibrio splendidus LGP32]
  misc_feature (8)..(262): NCBI GI: 86147634 Blast Desc: 4'-phosphopantetheinyl transferase family protein [Vibrio sp. MED222] gi|85834545|gb|EAQ52694.1| 4'-phosphopantetheinyl transferase family protein [Vibrio sp.
  misc_feature (8)..(261): NCBI GI: 84387726 Blast Desc: 4'-phosphopantetheinyl transferase family protein [Vibrio splendidus 12B01] gi|84377409|gb|EAP94276.1| 4'-phosphopantetheinyl transferase family protein [Vibrio 12B01]
  misc_feature (8)..(259): NCBI GI: 163751060 Blast Desc: 4'-phosphopantetheinyl transferase family protein [Shewanella benthica KT99] gi|161329221|gb|EDQ00220.1| 4'-phosphopantetheinyl transferase family protein [Shewanella
  misc_feature (51)..(193): Pfam Id: PF01648 Pfam Desc: 4'-phosphopantetheinyl transferase superfamily
  misc_feature (121)..(184): Pfam Id: PF01648 Pfam Desc: 4'-phosphopantetheinyl transferase superfamily
MLESHLDVDLWLCPLGGLNECPKHITTLKKRLTNDEVTKVERYRQAKAQLKALYTRHYLRSVLSRYSMNNPESWRFDYGEKGKPSLCSTQFAQTGIVFNISHSQEHLVIAVCKSVDQGILLGVDIEHSRKNTDIHAIMKHYFTHEEIAVLETLNDEAQRERFFDLWVLKESYIKATGQGLATSLKSFYFDFKNQEQHLHNVANEAPLIGYPSQVRLFKGISIHSHESTQACNVAKDRSPTGWQCLLGKLNETFRFAVSVGGTDKAIVLRIKAIDTDSLR

SEQ ID NO: 47 - DNA, 3289 bp, Labyrinthuloides minuta
  misc_feature: SGI cDNA ID NO. 643070
  misc_feature: PfaA gene
  misc_feature: Encodes the peptide sequence at SEQ ID NO 48
  misc_feature: Useful for modulating production of PUFA
atggatacgcgcatagctattattggcatgagtgccattctcccgggtggagaaaatgttttcgagtgtgctgaaacgattcgagcggggcttaacaaaattcaggagcttccggacaatagagtagatgtaaccgcatatttcaatccagacaagacggttaaagataaaatttactgtaaacgtgggggtttcattcctgactttgactttgacgccagagaatatggaatgaacatgtttcaaatggaggattctgatgcgaatcagacactttctttgctgaaagtaaaagaggcgcttcaagatggaggtgtggaaccgtttacaaagaaaaagaaaaacattggctgcgttcttggtattggtggaggacagaaggcgtcgcacgaattctattctagactcaactacgttgtagtggagaaagtgctgcgcaagatgggaatgcccgaagaggatgttgccgttgctgtagacaaatataaagcaaattttcctgaatggcgacttgactcattccccggttttcttggaaatgttacggcgggaagagcaactaacgttttcaatatggatggtatgaattgtgttgttgatgcagcctgtgcaagttccttaattgctctgaaagtcgctattgatgaactcctccatggagattgcgacatgatgataactggagcaacatgtactgacaactcgattggcatgtatatggcattttcaaaaactcctgttttctcaactgacaagggtctcactgcgtatgataaggatacaaaaggaatgttaataggagagggttcttgtatgtttcttctgaaaagatatgcagacgctgtaaaggacggagacactatccatgctgtcattcgtggttgcgcgtcttcaagtgacggaaaggcctctggaatatatacacccactatcgatggccaagaagaagctattagacgcgcttacaaacgagcaggagttgatcctggaaccgtcactttagtagaaggtcatggtacaggcacaccggttggagataaaattgagctgactgctcttaaccgtgtaatggctagtggacacgggaagaacaaggaacaagtcgctgttggaagtatcaagtctcagattggacatttgaaggcagtagctggatatgctggaatgattaaggttatcatggccttaaaacacaaaatgcttccaaaaactatcaatgtaaagaatccaccaactctggtagatggatcaaaaatccaagattcagcattgtacatcaatactgaaaaccgcccttggttcactgagcctgggatgcctagacgagctggtatttcaagctttggtttcggcggagcaaactatcattgtgtcttggaagagtacgaaaatgagcacgagaaagcataccgtatgaatcaccttgcccagcctgttattcttagtgcgcaaagtacaaatgctcttgtctctttgctagaatctgaaatatcagccttagcgtctagcactgatttcgtaagctacaatgctttcgttaaaaagtacgttgtcaagcccgtaccaattggacatgcacgtgtaggatttctagctcttgatgcatctcaagttttagacgtcctcaaagcatgtcaggatagatttaagaaggatatttcttcgacctcttggacattgcttagacaaagtgctcattttcgaagtaccggtattgaagcgaaagggaaagtcgcagctcttttctctggtcaaggagcccaatattccagtatgtttgctgatgttgcaatgaactggccacaatttagaagaggaatccaagccatggacaaagcctcggcgaaagtaagtggaaatcgcacaagtgcagttctatatccgcgtaagccatacgatgctgagccatcgaccacaaatgaagaaatatccagtgttagaaatgcacagcaaacaactgtagcttgctctattggggtctttgacattttaaaagatgctggggtaaaaccagattatgttgcaggccacagccttggtgaattctccgcattatatgctgcaggggtggttacaagggaacaagtttgtgaaatcgtatgtcatcgtgcagaatccatgagcaacgcgcagaaaggtgctgctgttggagcaatggccgctgtaattggcccgaatgctgatcgtatccaaccttctgctcctcaagtttgggttgcaaataagaatagcagttcacaggttgttctaacaggaaatcctcaagggttaaaagctgaatgcgacagacttggagcaaagggatttaagattgttaacttggcttgcagtgatgctttccatagtccttacatgcagaaagcacaagaaacttttgtcagtcgactttcccctatgcaaatgaatactttcgcaagaggggctcctaccatgttttcaaatgtgaccgccaaaccgtacccagtaggtagcaacccgaaagatattctgacaaaacacatggttagtagcgtgagatggattgaacaggtgaaagaaatgtacaatgccggagcccgcgtttttatcgagtacggtcctaagcagactttgactaaattagttagcgatattcttggagacaagtccgatgttttcactattgcggtcaacccttcttccaaatccgattctgatacgctccttcgtgagtgtgttattaagcttgcagtgcttggtctacccattacggattttgacccttgggaagttgagaacccattcaagctgaagcaggtgaagagaaagaaaacgacgctgagattgtctgcaacaacttatacatccaagaaaactcttctaaaccgtgaaaaaataatgaacgatggacgccaagtaacttatgcgaccaaatccattcccgttaaacccgatacctccaaaattgaggcactagagatgaaacttaaacaagctgaagaggaggctgcaaaactacaagtcgaactagcatctgttcaacaggaagccgcaacactccgcgcaagtgcagctgccaaggtttcgtcggcttcgcaatcaaatattgtcactaaacatagacaacaactggagacaatgttaaacgagtatgacgagattataactaaagtagaagggaaatcacaagaacgccgaaaatcaacttctgtttcgacatctgcttcccctgaacttctacaaaaggcagaaactgttgtacttgaagttttggcagcaaagactggatacgaagttgacatgattgaatctgatatggaacttgaaaccg

SEQ ID NO: 48 - protein, 1096 aa, Labyrinthuloides minuta
  misc_feature: SGI Peptide ID NO. 643070
  misc_feature: PfaA polypeptide
  misc_feature: Useful for modulating production of PUFA
  misc_feature (1)..(1096): NCBI GI: 158518689 Blast Desc: AF378327_1 polyunsaturated fatty acid synthase subunit A [Schizochytrium sp. ATCC 20888]
  misc_feature (2)..(1021): NCBI GI: 91793978 Blast Desc: beta-ketoacyl synthase [Shewanella denitrificans OS217] gi|91715980|gb|ABE55906.1| beta-ketoacyl synthase [Shewanella denitrificans OS217]
  misc_feature (2)..(1023): NCBI GI: 86147635 Blast Desc: omega-3 polyunsaturated fatty acid synthase PfaA [Vibrio sp. MED222] gi|85834546|gb|EAQ52695.1| omega-3 polyunsaturated fatty acid synthase PfaA [Vibrio sp. MED222]
  misc_feature (2)..(964): NCBI GI: 336310880 Blast Desc: omega-3 polyunsaturated fatty acid synthase subunit, PfaA [Shewanella sp. HN-41] gi|335865560|gb|EGM70576.1| omega-3 polyunsaturated fatty acid synthase subunit, PfaA [Shewanella sp.
  misc_feature (2)..(956): NCBI GI: 114562399 Blast Desc: beta-ketoacyl synthase [Shewanella frigidimarina NCIMB 400] gi|114333692|gb|ABI71074.1| beta-ketoacyl synthase [Shewanella frigidimarina NCIMB 400]
  misc_feature (3)..(281): Pfam Id: PF00109 Pfam Desc: Beta-ketoacyl synthase, N-terminal domain
  misc_feature (3)..(945): NCBI GI: 17229138 Blast Desc: heterocyst glycolipid synthase [Nostoc sp. PCC 7120] gi|17135466|dbj|BAB78012.1| heterocyst glycolipid synthase [Nostoc sp. PCC 7120]
  misc_feature (4)..(1085): NCBI GI: 282895492 Blast Desc: Beta-ketoacyl synthase [Raphidiopsis brookii D9] gi|281199525|gb|EFA74388.1| Beta-ketoacyl synthase [Raphidiopsis brookii D9]
  misc_feature (5)..(978): NCBI GI: 149909575 Blast Desc: polyunsaturated fatty acid synthase PfaA [Moritella sp. PE36] gi|149807279|gb|EDM67232.1| polyunsaturated fatty acid synthase PfaA [Moritella sp. PE36]
  misc_feature (5)..(967): NCBI GI: 111548647 Blast Desc: protein product [Moritella marina]
  misc_feature (5)..(955): NCBI GI: 90408112 Blast Desc: omega-3 polyunsaturated fatty acid synthase PfaA [Psychromonas sp. CNPT3] gi|90310798|gb|EAS38913.1| omega-3 polyunsaturated fatty acid synthase PfaA [Psychromonas sp. CNPT3]
  misc_feature (289)..(407): Pfam Id: PF02801 Pfam Desc: Beta-ketoacyl synthase, C-terminal domain
  misc_feature (581)..(891): Pfam Id: PF00698 Pfam Desc: Acyl transferase domain
MDTRIAIIGMSAILPGGENVFECAETIRAGLNKIQELPDNRVDVTAYFNPDKTVKDKIYCKRGGFIPDFDFDAREYGMNMFQMEDSDANQTLSLLKVKEALQDGGVEPFTKKKKNIGCVLGIGGGQKASHEFYSRLNYVVVEKVLRKMGMPEEDVAVAVDKYKANFPEWRLDSFPGFLGNVTAGRATNVFNMDGMNCVVDAACASSLIALKVAIDELLHGDCDMMITGATCTDNSIGMYMAFSKTPVFSTDKGLTAYDKDTKGMLIGEGSCMFLLKRYADAVKDGDTIHAVIRGCASSSDGKASGIYTPTIDGQEEAIRRAYKRAGVDPGTVTLVEGHGTGTPVGDKIELTALNRVMASGHGKNKEQVAVGSIKSQIGHLKAVAGYAGMIKVIMALKHKMLPKTINVKNPPTLVDGSKIQDSALYINTENRPWFTEPGMPRRAGISSFGFGGANYHCVLEEYENEHEKAYRMNHLAQPVILSAQSTNALVSLLESEISALASSTDFVSYNAFVKKYVVKPVPIGHARVGFLALDASQVLDVLKACQDRFKKDISSTSWTLLRQSAHFRSTGIEAKGKVAALFSGQGAQYSSMFADVAMNWPQFRRGIQAMDKASAKVSGNRTSAVLYPRKPYDAEPSTTNEEISSVRNAQQTTVACSIGVFDILKDAGVKPDYVAGHSLGEFSALYAAGVVTREQVCEIVCHRAESMSNAQKGAAVGAMAAVIGPNADRIQPSAPQVWVANKNSSSQVVLTGNPQGLKAECDRLGAKGFKIVNLACSDAFHSPYMQKAQETFVSRLSPMQMNTFARGAPTMFSNVTAKPYPVGSNPKDILTKHMVSSVRWIEQVKEMYNAGARVFIEYGPKQTLTKLVSDILGDKSDVFTIAVNPSSKSDSDTLLRECVIKLAVLGLPITDFDPWEVENPFKLKQVKRKKTTLRLSATTYTSKKTLLNREKIMNDGRQVTYATKSIPVKPDTSKIEALEMKLKQAEEEAAKLQVELASVQQEAATLRASAAAKVSSASQSNIVTKHRQQLETMLNEYDEIITKVEGKSQERRKSTSVSTSASPELLQKAETVVLEVLAAKTGYEVDMIESDMELET

SEQ ID NO: 49 - DNA, 1073 bp, Labyrinthuloides minuta
  misc_feature: SGI cDNA ID NO. 633914
  misc_feature: Encodes the peptide sequence at SEQ ID NO 50
  misc_feature: Useful for modulating production of PUFA
atggatgaacgcatcgccatagttgggatgtcagcagctctccctggaggggaaaatgtgaacgaaagctgggaaatgattaagggtcaactcgactgtttggatgaactcccagccgacagagtggatgtaactgcatattatcatcctgacaaaagtgtcccagacaaaatttattgtactagaggaggatttatgcctgattttgactttgatgctcgagaatttggcatgaatatgcatcaaatggaagacgccgattgtaatcaaactctaactcttttaaaggtaaaagaagcattaattgatgctggcattgaacctttcaccaaagaaagaaagaatgtcggttgtgttttaggcgtacttggaggacaaaaagcatcacatgagttctattctcgacttaactacactgttttagataaggttctgcgcaaaatgggactaccagagactgatattaataatgcggtagaaaaatataaatgtaactttccagaatggcggctggattcttttcctggatttttaacgaatgtaactgctggacgttgcaccaacactttcaacttagatggaatgaatgcctgcgtagacgcagcctgtgcaagttctctctgtgcccttaaagttgctattgaagaattgctttatgggaactgtagaacaatgatttgtggcgcaacgtgtactgactgttcggtaggaatgtatatgtcgttttctaaaactccagttttctcaaccgagaaatcagtaaaggcttttgatgaggatacaaaaggaatgatgatcggggaagggtcctgtatgtttattctgaaacgatacagcgacgctattgaagatggggatgaaatccatgctgtaatacgtggagttgctagttcgagtgatggtaaagcctctggcatatatactccaacagtttctgggcaagaaaagtgtatccgcagagcatacaaaagagccaatgtcgatcctcaaagtgtcacaatgatagaaggtcacggcacaggaacaagagttggagataagattgagttgacagctctaaagaatgtttttga

SEQ ID NO: 50 - protein, 357 aa, Labyrinthuloides minuta
  misc_feature: SGI Peptide ID NO. 633914
  misc_feature: Useful for modulating production of PUFA
  misc_feature (1)..(357): NCBI GI: 158518689 Blast Desc: AF378327_1 polyunsaturated fatty acid synthase subunit A [Schizochytrium sp. ATCC 20888]
  misc_feature (2)..(281): Pfam Id: PF00109 Pfam Desc: Beta-ketoacyl synthase, N-terminal domain
  misc_feature (2)..(357): NCBI GI: 127513593 Blast Desc: beta-ketoacyl synthase [Shewanella loihica PV-4] gi|126638888|gb|ABO24531.1| beta-ketoacyl synthase [Shewanella loihica PV-4]
  misc_feature (2)..(357): NCBI GI: 163751053 Blast Desc: omega-3 polyunsaturated fatty acid synthase PfaA [Shewanella benthica KT99] gi|161329214|gb|EDQ00213.1| omega-3 polyunsaturated fatty acid synthase PfaA [Shewanella benthica
  misc_feature (2)..(357): NCBI GI: 114562399 Blast Desc: beta-ketoacyl synthase [Shewanella frigidimarina NCIMB 400] gi|114333692|gb|ABI71074.1| beta-ketoacyl synthase [Shewanella frigidimarina NCIMB 400]
  misc_feature (2)..(357): NCBI GI: 294139973 Blast Desc: omega-3 polyunsaturated fatty acid synthase PfaA [Shewanella violacea DSS12] gi|293326442|dbj|BAJ01173.1| omega-3 polyunsaturated fatty acid synthase PfaA [Shewanella violacea
  misc_feature (2)..(357): NCBI GI: 149675716 Blast Desc: beta-ketoacyl synthase [Shewanella livingstonensis]
  misc_feature (2)..(357): NCBI GI: 212636304 Blast Desc: Omega-3 polyunsaturated fatty acid synthase PfaA [Shewanella piezotolerans WP3] gi|212557788|gb|ACJ30242.1| Omega-3 polyunsaturated fatty acid synthase PfaA [Shewanella WP3]
  misc_feature (2)..(357): NCBI GI: 2529418 Blast Desc: [Shewanella sp. SCRC-2738]
  misc_feature (2)..(357): NCBI GI: 91793978 Blast Desc: beta-ketoacyl synthase [Shewanella denitrificans OS217] gi|91715980|gb|ABE55906.1| beta-ketoacyl synthase [Shewanella denitrificans OS217]
  misc_feature (2)..(357): NCBI GI: 170725784 Blast Desc: polyketide-type polyunsaturated fatty acid synthase PfaA [Shewanella woodyi ATCC 51908] gi|169811131|gb|ACA85715.1| polyketide-type polyunsaturated fatty acid synthase PfaA woodyi
  misc_feature (289)..(357): Pfam Id: PF02801 Pfam Desc: Beta-ketoacyl synthase, C-terminal domain
MDERIAIVGMSAALPGGENVNESWEMIKGQLDCLDELPADRVDVTAYYHPDKSVPDKIYCTRGGFMPDFDFDAREFGMNMHQMEDADCNQTLTLLKVKEALIDAGIEPFTKERKNVGCVLGVLGGQKASHEFYSRLNYTVLDKVLRKMGLPETDINNAVEKYKCNFPEWRLDSFPGFLTNVTAGRCTNTFNLDGMNACVDAACASSLCALKVAIEELLYGNCRTMICGATCTDCSVGMYMSFSKTPVFSTEKSVKAFDEDTKGMMIGEGSCMFILKRYSDAIEDGDEIHAVIRGVASSSDGKASGIYTPTVSGQEKCIRRAYKRANVDPQSVTMIEGHGTGTRVGDKIELTALKNVF

SEQ ID NO: 51 - DNA, 2238 bp, Labyrinthuloides minuta
  misc_feature: SGI cDNA ID NO. 641571
  misc_feature: Encodes the peptide sequence at SEQ ID NO 52
  misc_feature: Useful for modulating production of PUFA
atggtcttaagagcagcagcctgtgaagaccttgatctgactttcccagggttgattgacttagaccctccagcagaagtagtagagcaaagggcagggaagacattagttttcgggggtgataagcagttagtatccttaattgaaaggaaagggctttcagcaagaagaatcgacaatggtttgagcgaagcaggtttgaagactgaactagagaaagctggttcggtcgaaagtattatttatattcacgatagtgaaccaatcgagaactgcttgcttgtagcaaagcatgcaaagcaattcctttctggatccagacaacagtttactgtcgttgttcgtggagatggcttcctgggatatagtggaaagtttgaaactgttgactccatcgaaaagtatgctttatgtggacttgtaaagacgattgctctagaatggccaaatgtacagtcaagatgtttagatattcataaatcggttccgacccaagaaacagcgaatttaattctttcagaagtaaatgatccagataagactcttcgagaggtatcatatgacatcagtctgaccagacgaggagtttcaacatcctctctcaaggcaggtaccgtaaaaacggcagtgagttccgatgatgtctggcttgtttgtggcggagcacgaggtattacaccattgtgcgtgaaggaaatggctagacgtgtaggcgggggcacctactatttaatgggaaggtcccaacttgaagaattgcctcaatgggctgttggtgtagacgaaaaagacctgcaaaagtcggcgattaagcatatcaaagctaaaggtgaaaaacccagacctgcgatgcttcggaagatggtgaataaggtcattgctacaaaagaggtgaagcagaacattgacgaaattggaaaattctgtggaggaaaggtacactacatttcctgtgatattacatctgggtctagtgtaaagacagctttggcaaagcttccgtccataaccggattgtttcacgcttcaggagtgcttagagataaacttattgtgagcaaagctgttgaagattttagaactgtttatgatacaaaagttttgggattcaagaatatatacgataacttggaccactcggctctgaaacattgtatactattctcttctttggctggttttcatggaaatgtcggccagagtgactactctatggcaaatgaagttttgaataagattgcatatatgttagaccagaagggactttcagcaaaagcttttgattttggcccttgggatggtggtatggttactccagctttgaaaaaacactttcaaagtcaaggtgtacaaatcattgaccgaccggacggcgcaaaaactgttgccaacatgataaccgattgtagcccaagtcaaatactggttggtaactggggattgcctccaagcaagccagaccaaagaaaatggaaactgcttcaaactatcaacacaagttcattgctaaatgaccataagataaaagggcataaaatcctgcctttcactttcagtatgtcattgcttgctgaaaaggttcttggtctttaccctggctatcatttattaagtattgaagacgttaatctgttcaaaggaatcacccttgatagtggaatgcagtgtgaaatatccatcgaggagtctaaagaagaatcagggaaaattttcgtgtctactgacttgaaacagatagtaaatggaaaacgggttccatcttacaaggcggttgttgtgcttggaggaaaagctcctgtttctaagatgattccagttcaagctgtcactgggcaaaccttgaacaaagagacaatttacaatgacattctgtttcatgggcctaagttccaagggattcaaacagtgtcaatagctgatcttaagcttcaagctgagtgtcagttaccagccgacgtacctgcccaacctgtagcctttgacttgcttttccaagctgcgattatcttagcgaaacaagttcgaggagttctgtcattaccttcgaatattgaagaagtcaaaatcttgaagcccgtgactcctgaaacggataaatttcaaatcactatgtctaaagatggtggtagcaaaagtgacagcgtatggaaaatggagtatgcaatgcatgacgaagctggcaatctttttaatgaaggtcgaataagtgttgtattaaacgacaagctagtattttag

SEQ ID NO: 52 - protein, 745 aa, Labyrinthuloides minuta
  misc_feature: SGI Peptide ID NO. 641571
  misc_feature: Useful for modulating production of PUFA
  misc_feature (3)..(745): NCBI GI: 158518689 Blast Desc: AF378327_1 polyunsaturated fatty acid synthase subunit A [Schizochytrium sp. ATCC 20888]
  misc_feature (59)..(732): NCBI GI: 71277928 Blast Desc: polyunsaturated fatty acid synthase PfaA [Colwellia psychrerythraea 34H] gi|71143668|gb|AAZ24141.1| polyunsaturated fatty acid synthase PfaA [Colwellia psychrerythraea 34H]
  misc_feature (60)..(682): NCBI GI: 149909575 Blast Desc: polyunsaturated fatty acid synthase PfaA [Moritella sp. PE36] gi|149807279|gb|EDM67232.1| polyunsaturated fatty acid synthase PfaA [Moritella sp. PE36]
  misc_feature (60)..(682): NCBI GI: 111548647 Blast Desc: protein product [Moritella marina]
  misc_feature (60)..(697): NCBI GI: 90408112 Blast Desc: omega-3 polyunsaturated fatty acid synthase PfaA [Psychromonas sp. CNPT3] gi|90310798|gb|EAS38913.1| omega-3 polyunsaturated fatty acid synthase PfaA [Psychromonas sp. CNPT3]
  misc_feature (67)..(732): NCBI GI: 37522418 Blast Desc: glr2849 [Gloeobacter violaceus PCC 7421] gi|35213419|dbj|BAC90790.1| glr2849 [Gloeobacter violaceus PCC 7421]
  misc_feature (69)..(731): NCBI GI: 282895492 Blast Desc: Beta-ketoacyl synthase [Raphidiopsis brookii D9] gi|281199525|gb|EFA74388.1| Beta-ketoacyl synthase [Raphidiopsis brookii D9]
  misc_feature (87)..(731): NCBI GI: 218778909 Blast Desc: polyketide-type polyunsaturated fatty acid synthase PfaA [Desulfatibacillum alkenivorans AK-01] gi|218760293|gb|ACL02759.1| polyketide-type polyunsaturated fatty
  misc_feature (104)..(693): NCBI GI: 170725784 Blast Desc: polyketide-type polyunsaturated fatty acid synthase PfaA [Shewanella woodyi ATCC 51908] gi|169811131|gb|ACA85715.1| polyketide-type polyunsaturated fatty acid synthase PfaA woodyi
  misc_feature (104)..(693): NCBI GI: 157962726 Blast Desc: polyketide-type polyunsaturated fatty acid synthase PfaA [Shewanella pealeana ATCC 700345] gi|157847726|gb|ABV88225.1| Polyketide-type polyunsaturated fatty
  misc_feature (216)..(434): Pfam Id: PF08659 Pfam Desc: Ketoreductase domain (KR)
  misc_feature (299)..(421): Pfam Id: PF00106 Pfam Desc: short chain dehydrogenase
MVLRAAACEDLDLTFPGLIDLDPPAEVVEQRAGKTLVFGGDKQLVSLIERKGLSARRIDNGLSEAGLKTELEKAGSVESIIYIHDSEPIENCLLVAKHAKQFLSGSRQQFTVVVRGDGFLGYSGKFETVDSIEKYALCGLVKTIALEWPNVQSRCLDIHKSVPTQETANLILSEVNDPDKTLREVSYDISLTRRGVSTSSLKAGTVKTAVSSDDVWLVCGGARGITPLCVKEMARRVGGGTYYLMGRSQLEELPQWAVGVDEKDLQKSAIKHIKAKGEKPRPAMLRKMVNKVIATKEVKQNIDEIGKFCGGKVHYISCDITSGSSVKTALAKLPSITGLFHASGVLRDKLIVSKAVEDFRTVYDTKVLGFKNIYDNLDHSALKHCILFSSLAGFHGNVGQSDYSMANEVLNKIAYMLDQKGLSAKAFDFGPWDGGMVTPALKKHFQSQGVQIIDRPDGAKTVANMITDCSPSQILVGNWGLPPSKPDQRKWKLLQTINTSSLLNDHKIKGHKILPFTFSMSLLAEKVLGLYPGYHLLSIEDVNLFKGITLDSGMQCEISIEESKEESGKIFVSTDLKQIVNGKRVPSYKAVVVLGGKAPVSKMIPVQAVTGQTLNKETIYNDILFHGPKFQGIQTVSIADLKLQAECQLPADVPAQPVAFDLLFQAAIILAKQVRGVLSLPSNIEEVKILKPVTPETDKFQITMSKDGGSKSDSVWKMEYAMHDEAGNLFNEGRISVVLNDKLVF

SEQ ID NO: 53 - DNA, 6054 bp, Labyrinthuloides minuta
  misc_feature: SGI cDNA ID NO. 638028
  misc_feature: PfaB gene
  misc_feature: Encodes the peptide sequence at SEQ ID NO 54
  misc_feature: Useful for modulating production of PUFA
atgtctaccccttacgaagaaagctcgactgcaaaatgtaagcggagacgagcagaacgaggtggagaccagcggatcgctgtagttggcatggcagttcattatgctggatgtcctaataaagaggttttctgggattctttgctgaaaaagggggtaaacagtggccctctgaccgagtctagacttggtactaaagacaaaaatcttcactacaagaaggaaagaagcaagtattccgacactttctgtaatgaccgttacgcaactattgaagaaaagtataccaatgaacatgacttgcttctcggactagctcgtgacgctttaaaggacgctgcggataagaaaggagtaagagagttcccagtgaagaattgtggcatcgttagtggatgtctatcatttccaagagatgatacccaaggagagctccttaatctttatcaaactcatactgaatcaaaatttaatgaggtattcgaaggtgcccctctgttcaaagaccagtccctttggtctagtcgcccaacgtcgcttaacgctacagcagaatgcaaacgcggctacatggatccagcctcgtatgttgcagatgagcttgatctgaacggattgcattattcacttgatgccgcatgtgcatctgctctctacgttcttcgtcttgctcaggagcatctcctatcgggtgatgctgatgtaatgatggctggcgcttcgactctaccagatccgtttttcattgtttcggggttttctacgtttcaagcaatgccagtagcaggcacagagaccgacatttctcttccgtggaattcaaaatcaactggcttgacaccaggtgagggtggggctatcatggttctgaagcgcttgtctgatgctgtacgagatggtgatcatatttatggcgtgatgatgggcgttggaataaacaacgcaggctgtgggcttcctttgaaaccgcacatgcccagtgaacttggatgtatgagagaaacctacaacataattgaatcaggaaaggaaaaatatgggaattctggatttagcaagaatgtgcaatatgttgaatgtcatgcgacgggaacgtcccaaggggacagagttgaaattgaggccatgaagcaatgctttggtaccctaccattattcggatccacaaagggcaattttggtcataccctggtcgcagcagggtttgcaggcatgtgcaaactactgctttcaatggagaaaggacaaattcctccaacccccggggtgaatgaagtaactgctatggacaagaatgttgtgaaagatactgttgcttggcctgacacaaaaggggatgtgaaacgcggagcattatctgcatttggattcggtggaacaaatggccacgctgtttttgaggagtataaaccagaccgcactccaagaattgtttcactgaagccgattgctcccgaaatgtcgaaagtcgcgataattggtatggattgtcattttggtactctgaatgggcttggagcttttgagcgcgcaatttacaatggtagtgatggcgcatgtatacttcctccaaaaagatggagatttttaggtgacgacactgatttcttgaaaacattagaaatagaaagcaaaccatatggatgctttgtttctgatgtcacagttaactttagacgattgcgtactcctttaacccctgaagacatgcttatgccacagcaattgattgccgtaaagacaattgaccgcgctattttggattctggactgaaaaaaggtagcagggttgcggtacttgttgggcttggaactgacatggagttgtacagacatcgcggaagagtagctctaaaggagaggcttcagaaggccatacaaactgcaaacgatggggaagtcgcaaacgctctgatggattatattcatgaccgtggcacttcgacatcatacacatcatatattggtaaccttgtcgctactagaatttcttcgcaatgggggtttattggtccttcattttcaattactgagggggagaattcagttcttcgttgcgttgctttaggtagaatcttacttcaaattggaaatgttgatgcagtagtcgttgctggagttgatctatgtgggaacgcggaaaatttgtacttcaaaagcagaagacaccaaatttcttcgaaacgattcccacaagcacctttctctgccgatgctgacggattctttatcggggaaggttctggagcacttgttttgaagcaatcttctgatctatcagcgtctcagaaagtgtacgccactatagattccatggtctgcggtcaaaacgttcaaacttgcgcggaagaagcagtaaaactagcaaaactaccatctgaagataaggtcgaacttcttgacgtgtctggactttcgtctgcctctcttaaatgtacttcttctagtcctacatctgaagaagagatcgaagcactgggaaacgtttacactaaatgtcaaactggaggaaagtcgaacaggaatgtacttttaagttcaacatctgcgacggtaggacaggtaggatatgctgcgggggccgctggcttaattaaagctgcactctgcttgtacaatcgctatttaccgggaactagcaggtttgataaacctagaaatattgattcttttccggattccttttatgtaaacaaacattcctcaccctgggttaaggacaatagcagggaaagaaggcatgcagcagtttccagtctttccgataccaaatccgtctttcatactatactgtccgatgtggaaggaaatcatgaaacgaagagtttattctcaattgatccctgtatgaagaaagttgtcagtatcaccgctagtgatgtagacgaaatgcttagcaagttggtcgccgtcaaagacagcactaatattgaactcgagttcgaaaatcttgtccgtcagactctaaaagaagataatacaattccaagtagtgggatagttctatgtttggtcgcaaatgctgacacccttgtccaagaagtgaccagcgctttaaaaggaattccaagagcaattaaaatgaaccgagactatgtgtctggctctggtagctacttggcaatgaagccgctgagaagtagcaaaatagctttcatgtatggagaaggccgaagtccctacttgggtcttggaaaagatatgtttcgtgtctggcctggaatgcatgagtttgtagaagacagaacaactaaaatgtgggcaaggaatggagatgatgagtttcatcctcgttgtctcacgcaaagtgagagggatgagcgggttgaagagttcgacgaaaatatgatatcgaattttagatctggtgtatttcatgctatgtgcttcactggattagctgaaaatgtccttgggatccaacctaaagcaagctttggcctttctttgggagagatatccatgatgtttgcattttctaagaaaaattgtttagaatcaaacgaaatgaccactagattagcgaattcgcctgtttggaatgaggaactggctgtaaaatgcaatgctgtcagaagaaaatggaacattccggaagacgaacctcttcagaaatactggactggatatatgatacagggttctagaagagacattgaacgtgctattgggaacagagacgatgttagacttatgatcgtgaacaattctagttcggctctgattgctggcagacccgctgcatgcaaagatgttataaagcagcttggaaataaaccagctctggaattaccgcaaagaatgatcggccattgtccagaggtagcgccttctgttgaaagtattggtcaaattcattccacgttagaaattcctgcaacgagtcaccagatgtacactacggtaaccaattcgccacttcaaggaggaactcaaatgaaactccatgctggaaatgtatacttaaagatagctgatttcccagcaattgtagaaagtgtacggggagacggatatgacgtttttattgaactcggcgccggaaatacccgctccatgtcggtgaaagagattctgagtaaacctaaaggacaggctcagctgccatttgtatcagttgccattgatcgcgaaggaaaacagacttgggatcagctcatgacaatgatggcagtattaaagagtcaccagactcctggtgtaaaactagccagtatttaccacaatatattggcgaaggaaccagaaaaggtaaacaaacttttgcgaactattgaggtaaacgggaggttcaaaggtgttagcagaaaagctattcctgagactctgctgaaggaagttattcaatcaggtaataagtacaaagtgccctcaccttacagaatcattcgatcatctttaccgttcaataaaacagtggtcccaaaaactacaattagtcccaataaacagtcgtctgctggaaatccccaggatattgaatctacgggtcttgcagacactaaaaaccttggcagcttaaaaagactgtttctgcaactcagcaagcccttctctctaccgtcaacatcctctgctagaagaaaggtagtcgaacctgtcacttttcaagatataggagacaagaaattcatggattgctataaagtttgtgcacctttgtacacaggggcaatggctaaaggcatagcatctgcagatttggtaattgcagctggacgtagaggacttctcgcctctttgggagcaggaggtctgcctatggattctgtcaaagcggctttggaaaaaatacagaaagctttaccaaaaggaccttttgcagttaacttgattcattctccatttgatccaaacctggaaaaagattgtgtcgatctgttgctcgatagaggagtgacagtagtagaagcttctgcttttatgcagttgacttacgatgttgtaagatatcgagtagctggattattcaaaaaagatcctgccgagggaattactgctcgtaatattggcataagaaaccgaatcattgccaaaatttctagaactgaattagctgaaatgtttattcgtcccgcgcctgaagcttggctttcaaagctcttacggaataacgacatcactcctgaacagtatcagatggcaaaactggttcctatgtcggacgacattacggttgaatcagattctggtggccacactgacaacagacctcttcatgttgttttcccaattgttctaaatttaagaaatcgacttcacaaggaattggcttatcctgactttcttcgtgttcgagtaggagcagcgggtggaattggttgtcctgaggcagctgccgcagctttcaacatcggagctgcttttgttgttacaggaactgtgaaccaactgtgcaaacaatctggtacttcagatacagtaagaaagcttctttctaccgcgtcttactctgatgtgacaatggctccggccgctgacatgtttgaacagggcgttgagttacaagtgcttaaaaaaggaaccatgtttccatcccgagcaaagaaactgagggaattgtttgttaaatacgattcgtttgacgaaatgccaagatcagaattggaacgtctggaaaagagaatctttcgcaagtcagttgcagaagtttgggaggaaacaaccgatttttacatcaatcgtctgaggaatcctgataagatagctcgtgctgaattagatggtaaattgaagatgtcactctgtatgagatggtatttggggctgtcttcgttttgggcgaataatggcatagccgaaagagccattgattatcaagtatggtgtggacctgctattggttcctttaacgactttatcaagggcacttatctagatgtgaatgataaaaagtcatctggtcaatttccttgcgttgtccaaacgaatctccagattcttactggagcatgctatttacatcgcatacaccaagctcagagtttccgagacgttgaattagatctagacgccaatgacttgagaacttacagaccagaatatcctctataa

SEQ ID NO: 54 - protein, 2017 aa, Labyrinthuloides minuta
  misc_feature: SGI Peptide ID NO. 638028
  misc_feature: PfaB polypeptide
  misc_feature: Useful for modulating production of PUFA
  misc_feature (19)..(1997): NCBI GI: 158518691 Blast Desc: AF378328_1 polyunsaturated fatty acid synthase subunit B [Schizochytrium sp. ATCC 20888]
  misc_feature (24)..(296): Pfam Id: PF00109 Pfam Desc: Beta-ketoacyl synthase, N-terminal domain
  misc_feature (24)..(1469): NCBI GI: 119511081 Blast Desc: Beta-ketoacyl synthase [Nodularia spumigena CCY9414] gi|119464252|gb|EAW45170.1| Beta-ketoacyl synthase [Nodularia spumigena CCY9414]
  misc_feature (24)..(1459): NCBI GI: 218778908 Blast Desc: beta-hydroxyacyl-(acyl-carrier-protein) dehydratase FabA/FabZ [Desulfatibacillum alkenivorans AK-01] gi|218760292|gb|ACL02758.1| dehydratase FabA/FabZ alkenivorans
  misc_feature (24)..(1544): NCBI GI: 186680590 Blast Desc: beta-ketoacyl synthase HglC [Nostoc punctiforme PCC 73102] gi|186463042|gb|ACC78843.1| beta-ketoacyl synthase HglC [Nostoc punctiforme PCC 73102]
  misc_feature (24)..(1478): NCBI GI: 332293044 Blast Desc: PfaB family protein [Krokinobacter diaphorus 4H-3-7-5] gi|332171130|gb|AEE20385.1| PfaB family protein [Krokinobacter sp. 4H-3-7-5]
  misc_feature (24)..(1437): NCBI GI: 91218438 Blast Desc: glycolipid synthase [Psychroflexus torquis ATCC 700755] gi|91183429|gb|EAS69830.1| glycolipid synthase [Psychroflexus torquis ATCC 700755]
  misc_feature (24)..(1399): NCBI GI: 37521526 Blast Desc: glycolipid synthase [Gloeobacter violaceus PCC 7421] gi|35212523|dbj|BAC89898.1| gll1957 [Gloeobacter violaceus PCC 7421]
  misc_feature (24)..(1478): NCBI GI: 149369396 Blast Desc: SCB49_06212 [unidentified eubacterium SCB49] gi|149356823|gb|EDM45378.1| SCB49_06212 [unidentified eubacterium SCB49]
  misc_feature (25)..(1399): NCBI GI: 297193000 Blast Desc: LOW QUALITY PROTEIN: beta-ketoacyl synthase [Streptomyces pristinaespiralis ATCC 25486] gi|297151605|gb|EFH31268.1| LOW QUALITY PROTEIN: beta-ketoacyl
  misc_feature (352)..(421): Pfam Id: PF02801 Pfam Desc: Beta-ketoacyl synthase, C-terminal domain
  misc_feature (488)..(758): Pfam Id: PF00109 Pfam Desc: Beta-ketoacyl synthase, N-terminal domain
  misc_feature (812)..(882): Pfam Id: PF02801 Pfam Desc: Beta-ketoacyl synthase, C-terminal domain
  misc_feature (1048)..(1361): Pfam Id: PF00698 Pfam Desc: Acyl transferase domain
  misc_feature (1219)..(1363): Pfam Id: PF00698 Pfam Desc: Acyl transferase domain
  misc_feature (1495)..(2007): NCBI GI: 158518693 Blast Desc: AF378329_1 polyunsaturated fatty acid synthase subunit C [Schizochytrium sp. ATCC 20888]
  misc_feature (1535)..(1989): Pfam Id: PF03060 Pfam Desc: Nitronate monooxygenase / enoyl reductase
  misc_feature (1543)..(1836): Pfam Id: PF03060 Pfam Desc: Nitronate monooxygenase / enoyl reductase
MSTPYEESSTAKCKRRRAERGGDQRIAVVGMAVHYAGCPNKEVFWDSLLKKGVNSGPLTESRLGTKDKNLHYKKERSKYSDTFCNDRYATIEEKYTNEHDLLLGLARDALKDAADKKGVREFPVKNCGIVSGCLSFPRDDTQGELLNLYQTHTESKFNEVFEGAPLFKDQSLWSSRPTSLNATAECKRGYMDPASYVADELDLNGLHYSLDAACASALYVLRLAQEHLLSGDADVMMAGASTLPDPFFIVSGFSTFQAMPVAGTETDISLPWNSKSTGLTPGEGGAIMVLKRLSDAVRDGDHIYGVMMGVGINNAGCGLPLKPHMPSELGCMRETYNIIESGKEKYGNSGFSKNVQYVECHATGTSQGDRVEIEAMKQCFGTLPLFGSTKGNFGHTLVAAGFAGMCKLLLSMEKGQIPPTPGVNEVTAMDKNVVKDTVAWPDTKGDVKRGALSAFGFGGTNGHAVFEEYKPDRTPRIVSLKPIAPEMSKVAIIGMDCHFGTLNGLGAFERAIYNGSDGACILPPKRWRFLGDDTDFLKTLEIESKPYGCFVSDVTVNFRRLRTPLTPEDMLMPQQLIAVKTIDRAILDSGLKKGSRVAVLVGLGTDMELYRHRGRVALKERLQKAIQTANDGEVANALMDYIHDRGTSTSYTSYIGNLVATRISSQWGFIGPSFSITEGENSVLRCVALGRILLQIGNVDAVVVAGVDLCGNAENLYFKSRRHQISSKRFPQAPFSADADGFFIGEGSGALVLKQSSDLSASQKVYATIDSMVCGQNVQTCAEEAVKLAKLPSEDKVELLDVSGLSSASLKCTSSSPTSEEEIEALGNVYTKCQTGGKSNRNVLLSSTSATVGQVGYAAGAAGLIKAALCLYNRYLPGTSRFDKPRNIDSFPDSFYVNKHSSPWVKDNSRERRHAAVSSLSDTKSVFHTILSDVEGNHETKSLFSIDPCMKKVVSITASDVDEMLSKLVAVKDSTNIELEFENLVRQTLKEDNTIPSSGIVLCLVANADTLVQEVTSALKGIPRAIKMNRDYVSGSGSYLAMKPLRSSKIAFMYGEGRSPYLGLGKDMFRVWPGMHEFVEDRTTKMWARNGDDEFHPRCLTQSERDERVEEFDENMISNFRSGVFHAMCFTGLAENVLGIQPKASFGLSLGEISMMFAFSKKNCLESNEMTTRLANSPVWNEELAVKCNAVRRKWNIPEDEPLQKYWTGYMIQGSRRDIERAIGNRDDVRLMIVNNSSSALIAGRPAACKDVIKQLGNKPALELPQRMIGHCPEVAPSVESIGQIHSTLEIPATSHQMYTTVTNSPLQGGTQMKLHAGNVYLKIADFPAIVESVRGDGYDVFIELGAGNTRSMSVKEILSKPKGQAQLPFVSVAIDREGKQTWDQLMTMMAVLKSHQTPGVKLASIYHNILAKEPEKVNKLLRTIEVNGRFKGVSRKAIPETLLKEVIQSGNKYKVPSPYRIIRSSLPFNKTVVPKTTISPNKQSSAGNPQDIESTGLADTKNLGSLKRLFLQLSKPFSLPSTSSARRKVVEPVTFQDIGDKKFMDCYKVCAPLYTGAMAKGIASADLVIAAGRRGLLASLGAGGLPMDSVKAALEKIQKALPKGPFAVNLIHSPFDPNLEKDCVDLLLDRGVTVVEASAFMQLTYDVVRYRVAGLFKKDPAEGITARNIGIRNRIIAKISRTELAEMFIRPAPEAWLSKLLRNNDITPEQYQMAKLVPMSDDITVESDSGGHTDNRPLHVVFPIVLNLRNRLHKELAYPDFLRVRVGAAGGIGCPEAAAAAFNIGAAFVVTGTVNQLCKQSGTSDTVRKLLSTASYSDVTMAPAADMFEQGVELQVLKKGTMFPSRAKKLRELFVKYDSFDEMPRSELERLEKRIFRKSVAEVWEETTDFYINRLRNPDKIARAELDGKLKMSLCMRWYLGLSSFWANNGIAERAIDYQVWCGPAIGSFNDFIKGTYLDVNDKKSSGQFPCVVQTNLQILTGACYLHRIHQAQSFRDVELDLDANDLRTYRPEYPL

SEQ ID NO: 55 - DNA, 4305 bp, Labyrinthuloides minuta
  misc_feature: SGI cDNA ID NO. 640095
  misc_feature: PfaC gene
  misc_feature: Encodes the peptide sequence at SEQ ID NO 56
  misc_feature: Useful for modulating production of PUFA
atgggtaaactagcaactaggaacggggtgaaggtggcaaccaaaaaccccaagaagaagccagtatgggaaatgaccaaggaagagcaaaagaatgatacagacgtagtcttcgattacgatgagctcttggagtttgctgaaggagacattggcccagtgtttggtccaaagttcagcatcattgacaactattccaggagagtaagactcccagctgaggaatacctgttagtaagtcgagtcacgaaaatggatgctgaaccaaatcaattccgaattggagctaccatgacaactgaatatgatttaccggtaaatggagagctttcagaaggtggtgacatcccgtgggcaattcttgtagaatctggacagtgcgatttaatgcttatttcttacatgggaatcgactttcaatgcaaaggaaacagagtatatagacttcttgatacgaccttaactttttatggagtggcttacgaaggtgaaacgctaacctatgacatcaaggtgaatgggttcgcgaaaggaccaggaggcgaagtcagtatgtttttcttctcgtacgattgttactgtaatggacgactcttaattgaaatgaggaacggcgctgctggatttttcgacgacgaaactttagcgcaaggaaaaggggtaatacataccaaaggggagttattaaaaagatcaaagattgttaagcaagacatcaaacaattcatggtggagccatgcactcacaagacatctttttcggaaagcgatatgcaggctttagttgataaaaagtgggatcaagttatgggaaacaattattatcttgactataagctcactacaaagaaaatgcttatgattgaccgtgtgactcacattattccaaatggtggagcttatggattaggtcttctaattggagaaaagattcttgatccaaatcactggtatttcccatgccattttgtaaaagaccaggttatggctgggtccctcgtaagcgacgggtgttctcagctgttaaagctatacatggtgtggttaggatttttgaataaggttgaaccaggctttaaatttgttccagttgacggaactgcaaacaaagttcgttgtcgtggccaaatcagcccacataaaggaaagcttgtgtatgttatggaagtcagagaggtgggatatgactcgaacaacaatccatatgcggtagctgatgtcaacattattgacgttcatgaagaacttggacaaaccttcagttttgatgagttggaccaatacggaaaaggtgacctgtcgaagaaaatcgttgttgactttaaaggaattgcacttagaatgaaaggtactccaaaagatgcgaaagtatcactacccacgtctatctcatcaagcaaatcttgggaacatcctcttggtaaaatcgctgggaatccagtgccttcctttactccatcgccttaccctccacgtccaatttgcttcttgccatttccaaacaatccaatggacaataattctgaacctgggcaaatcccattgaattggttcaatatgagtgaattcatgtgtgggaaggtttcgaagtgcttgggcgatgagttcaaacgttttgacaattcaaaaacatccagaagtcccgcatttgatttagctttagttacacgagtaactgaagttactgacttagaacatggaaagttttttaatgttgacctgaatccatctaaaggaactatggtggcggagtttgattgtccaaaggacgcgtggttttataaaggaatgagtcatgatgcacatatcccttactcaatcattatggaaatcggccttcaaacctctggtgttttgacttcctgggtaaaggcacccctaacaatggacaaagatgatattctatttagaaatttggatgcaactgccgagttactaagagatgttgatgtaagagggaaaactattaagaacgtcagtaaatgcatggggtacaacatgctgggtaaaatgggcattcacaggttttcttttgagttgagtgttgatggagagccattttacaagggaactacctcttttggttggtttgttccggaagtatttgaatctcaagttggacttgacaacgggaaaactatgaaaccttggtatctagaaaacaaggtcccatcgtcagccattacaactttcagtgcagttgacactcctgaaggagctagaaagttggtagctaagcaaccaacaatggcaagaagatcatttcagtgtcagttcctagatactgttaacattattccaggaaactatggaatgcatggtaaaggctatgcttatggtaaaaagactgtgaacaaaaatgattggttcttctcttgccatttttggatggacccagttatgccaggttctctcggcatagaatcaatgtttcaactcatagaaagttatgttatcaatacagatctggcagtcaaatacaacatcagtaacccgaaaataactcatacaccaggggaaaccaaatggaaatacagaggacagttatctccaaagagcaagcagatggaatccgaagttcatatcaaacaagttgaaaaacaagccgatggcagcctggttttggttgctgatggatacttattagttgatggattgagagtatattttgcagaaagcttgcgtgtgagaattgaaagcggatctagttctgtggttccaacagttgctgcagggcccgaaaccccactttcaatggagcaactacgtgaaaaattacttgatcttagcgcacctgttaacttagctactaaagcaggtggtcagttagttcaactgtctgcaggtggtgaggaaattgcgccagtaacgattgcagatctgggggataaatccttcatggaaacttatggtgttgttgcacctatgtacactggcgctatggccaagggtattgcttctgcagatcttgtaatcgcagcaggtaaagctggaattcttggttcttttggtgctggaggccttcctatgcatattgttaaggaatctttggccaaaattcaagctgctctacctaatggaccttatgcagtgaatctaattcattctccatttgacagcaaccttgaagaaggaaatgtggacctgtttttggagaaaggagtgcatgtaattgaagcttcagccttcatggatcttacgcctcaagtggtgaggtacagagccgctggtttaaaacgtggtcccagtggtgaagttgttattacaaaccggatcattggaaaatgctcaaggacagaacttgccgaaatgttcattcgacctgcaccagaaaagctccttcgtaaattggtagaaagcggcaagattactgccgatcaggccgaaatggcgaagactgtcccaatggcagacgacgttgcagttgaggccgactctggtggacatactgataaccgccctcttcatgtaatcctgcctttaattattaatctacggaacaaaattcacaaagaatgtggctaccctgatagcttgcgagttcgtgtcggagctggtggtggtattgggtgtccctctgcagccttggcagcttataacatgggagctgcgtttattattaccggcacgataaatcaagtatgtaggcaatctggtacctgtgataatgttcgtaaggcgctgtctcaagcctcttactctgacattactatggcacctgcagcagatatgttcgatcaaggggtagagcttcaagtattgaagaaaggcacaatgtttccttctagggctaagaaactctatgaattgttttgcaagtacaattcttttgacgaaatgcctgcggaagaaatcaagcgactggagaagagaacatttcgcaagagtgtagcagaggtctgggaagaaacaaaggacttttacattaatcgcctgcacaatccagacaaaattgaaagagctgaaaaggacggaaagttaaaaatgtctctatgcttccgctggtacttgggactttcgtccttttgggcaaacaacggtattgaagacagagtaatggactatcaagtttggtgtggtcctgctattggagctttcaatgacttcgttaagggaacctatctagacgttgcacatccctcgtcgaacggccagtttccatgtgtcgtgcaagcaaacttgcaaattcttactggtgcttgttatcttgatcgtgtgaatcaagtgaaatctaaacgaaagctggaaatagacacaactgatgcgacattgttttctttcaaaccagaatctccaataagatag

SEQ ID NO: 56 - protein, 1434 aa, Labyrinthuloides minuta
  misc_feature: SGI Peptide ID NO. 640095
  misc_feature: PfaC polypeptide
  misc_feature: Useful for modulating production of PUFA
  misc_feature (19)..(1433): NCBI GI: 158518693 Blast Desc: AF378329_1 polyunsaturated fatty acid synthase subunit C [Schizochytrium sp. ATCC 20888]
  misc_feature (37)..(899): NCBI GI: 127513595 Blast Desc: Beta-hydroxyacyl-(acyl-carrier-protein) dehydratase, FabA/FabZ [Shewanella loihica PV-4] gi|126638890|gb|ABO24533.1| Beta-hydroxyacyl-(acyl-carrier-protein) dehydratase, FabA/FabZ
  misc_feature (37)..(899): NCBI GI: 212557791 Blast Desc: Multi-domain beta-ketoacyl synthase [Shewanella piezotolerans WP3]
  misc_feature (37)..(899): NCBI GI: 84387723 Blast Desc: omega-3 polyunsaturated fatty acid synthase PfaC [Vibrio splendidus 12B01] gi|84377406|gb|EAP94273.1| omega-3 polyunsaturated fatty acid synthase PfaC [Vibrio splendidus
  misc_feature (37)..(899): NCBI GI: 157376336 Blast Desc: omega-3 polyunsaturated fatty acid synthase PfaC [Shewanella sediminis HAW-EB3] gi|157318710|gb|ABV37808.1| omega-3 polyunsaturated fatty acid synthase PfaC [Shewanella
  misc_feature (37)..(899): NCBI GI: 2529420 Blast Desc: [Shewanella sp. SCRC-2738]
  misc_feature (37)..(899): NCBI GI: 157962728 Blast Desc: beta-hydroxyacyl-(acyl-carrier-protein) dehydratase FabA/FabZ [Shewanella pealeana ATCC 700345] gi|157847728|gb|ABV88227.1| dehydratase FabA/FabZ [Shewanella
  misc_feature (37)..(899): NCBI GI: 170725782 Blast Desc: beta-hydroxyacyl-(acyl-carrier-protein) dehydratase FabA/FabZ [Shewanella woodyi ATCC 51908] gi|169811129|gb|ACA85713.1| dehydratase FabA/FabZ [Shewanella
  misc_feature (37)..(899): NCBI GI: 167624924 Blast Desc: beta-hydroxyacyl-(acyl-carrier-protein) dehydratase FabA/FabZ [Shewanella halifaxensis HAW-EB4] gi|167354946|gb|ABZ77559.1| dehydratase FabA/FabZ [Shewanella
  misc_feature (283)..(409): Pfam Id: PF07977 Pfam Desc: FabA-like domain
  misc_feature (758)..(891): Pfam Id: PF07977 Pfam Desc: FabA-like domain
  misc_feature (910)..(1413): NCBI GI: 158518691 Blast Desc: AF378328_1 polyunsaturated fatty acid synthase subunit B [Schizochytrium sp. ATCC 20888]
  misc_feature (965)..(1254): Pfam Id: PF03060 Pfam Desc: Nitronate monooxygenase / enoyl reductase
MGKLATRNGVKVATKNPKKKPVWEMTKEEQKNDTDVVFDYDELLEFAEGDIGPVFGPKFSIIDNYSRRVRLPAEEYLLVSRVTKMDAEPNQFRIGATMTTEYDLPVNGELSEGGDIPWAILVESGQCDLMLISYMGIDFQCKGNRVYRLLDTTLTFYGVAYEGETLTYDIKVNGFAKGPGGEVSMFFFSYDCYCNGRLLIEMRNGAAGFFDDETLAQGKGVIHTKGELLKRSKIVKQDIKQFMVEPCTHKTSFSESDMQALVDKKWDQVMGNNYYLDYKLTTKKMLMIDRVTHIIPNGGAYGLGLLIGEKILDPNHWYFPCHFVKDQVMAGSLVSDGCSQLLKLYMVWLGFLNKVEPGFKFVPVDGTANKVRCRGQISPHKGKLVYVMEVREVGYDSNNNPYAVADVNIIDVHEELGQTFSFDELDQYGKGDLSKKIVVDFKGIALRMKGTPKDAKVSLPTSISSSKSWEHPLGKIAGNPVPSFTPSPYPPRPICFLPFPNNPMDNNSEPGQIPLNWFNMSEFMCGKVSKCLGDEFKRFDNSKTSRSPAFDLALVTRVTEVTDLEHGKFFNVDLNPSKGTMVAEFDCPKDAWFYKGMSHDAHIPYSIIMEIGLQTSGVLTSWVKAPLTMDKDDILFRNLDATAELLRDVDVRGKTIKNVSKCMGYNMLGKMGIHRFSFELSVDGEPFYKGTTSFGWFVPEVFESQVGLDNGKTMKPWYLENKVPSSAITTFSAVDTPEGARKLVAKQPTMARRSFQCQFLDTVNIIPGNYGMHGKGYAYGKKTVNKNDWFFSCHFWMDPVMPGSLGIESMFQLIESYVINTDLAVKYNISNPKITHTPGETKWKYRGQLSPKSKQMESEVHIKQVEKQADGSLVLVADGYLLVDGLRVYFAESLRVRIESGSSSVVPTVAAGPETPLSMEQLREKLLDLSAPVNLATKAGGQLVQLSAGGEEIAPVTIADLGDKSFMETYGVVAPMYTGAMAKGIASADLVIAAGKAGILGSFGAGGLPMHIVKESLAKIQAALPNGPYAVNLIHSPFDSNLEEGNVDLFLEKGVHVIEASAFMDLTPQVVRYRAAGLKRGPSGEVVITNRIIGKCSRTELAEMFIRPAPEKLLRKLVESGKITADQAEMAKTVPMADDVAVEADSGGHTDNRPLHVILPLIINLRNKIHKECGYPDSLRVRVGAGGGIGCPSAALAAYNMGAAFIITGTINQVCRQSGTCDNVRKALSQASYSDITMAPAADMFDQGVELQVLKKGTMFPSRAKKLYELFCKYNSFDEMPAEEIKRLEKRTFRKSVAEVWEETKDFYINRLHNPDKIERAEKDGKLKMSLCFRWYLGLSSFWANNGIEDRVMDYQVWCGPAIGAFNDFVKGTYLDVAHPSSNGQFPCVVQANLQILTGACYLDRVNQVKSKRKLEIDTTDATLFSFKPESPIR

SEQ ID NO: 57 - DNA, 7899 bp, Artificial Sequence
  Unknown bacterial isolate SGI-i1605
  misc_feature: PfaA gene
  misc_feature: SGI cDNA ID NO. 1512567
  misc_feature: Encodes the peptide sequence at SEQ ID NO 58
  misc_feature: Useful for modulating production of PUFA
atgtcaaaaaagcaaaccacaaacccagcgtcggataagcgactcaactctcgcttgcaagaaacgccgattgcaattgttggtatggcttcggtttttgctgagagtaaaaatcttggacaattttgggatactatcgttaattctgtgaatggcattcaagatgtgccagaggacagatgggctatcgatgattattattctgccgataaaaaagaagcggataaaagttattgtaaacgcggcgcttttctacccgagattgattttgatccaatggaatttggtttaccaccgaacttattagaattaacagatattacacagttaatggctttagtggttgcgcgtgatgtattagctgatgccggtgtcagtgaagaaagtagttttgaccgtgataaaatgggcattgtattaggagtaggtggcggccaaaaacaaggcggacaattaatgtctcgtctacaaggccccgtacttgagaaagttttaaaagcttcaggccttagtccagatgatacgcaagttatcgtggacaaatttaagaaggcttatattccctgggaagaaaattcgttccccggtatgttaggtaacgttattgctggccgtatcgcgaatcgttttaattttggtggtactaactgtgtggttgatgctgcttgtgcgggttctttatctgcgatcaaaatggcggtttcagatttattagaataccgctcagatatgatgttatcaggtggtatttgctgcgataactcaccattcatgtacatgtcattttctaaaactcctgcttttaccgacggagattgtattcgtccttttgatgataaatcgaacggaatgatgatcggtgaaggggtagggatgatcgctctaaaacgtttagaagatgctgaacgtgacggtgaccgaatctattctgttattaaaggtattggtagttcatccgatggtaaatttaaatctatttatgctcctcgtccagaaggacaattaaaagcattaaaacgtgcctatcaagatgccggttttgacccaaaaacctgtggcttaattgaagctcatggcactggcactaaagcgggcgatgcagcagagtttagaggcttagagttattatttagtgaaaataacgatcaaaaacagcacgttgcccttggttctgttaagtctcaagtgggacatactaaagcggctgcaggcgcggcgggtttaatcaaagcatcactcgctttacatcataaggtgttaccagccactattaatgtagataaaccaaatcaaaatttagatattgaaaatacacctttgtatatcaatactgaaactagaccttggatgcaacgtgctgatggcgctaagcgtcaagcgggtattagctcatttggctttggcggtacgaattttcatttagtgttagaagaatacacacaaaaccaacaaggtgcatatcgattaaatgaggttgcacagacgttgttatttgctgccgataataaacagtctttaattaaaacattaaaaactgaattagcttctttgcaggtagaccctgaacaacaattctatgcgcttaatcagttgatcctttcgtatccgattaagaaagtagcagaaaaacaagctcgctgtggttttgtcgccaagggagttgagcaaacaattaagctgttgcaacagctaatcactcaattaaccactgatcaaaatagtgaatggtcaacaccgactggactttattatcgtgaacaggctttgccaactaatggcaaagtagtggctttattctctggtcaaggctctcagtatgtcaatatgggccgtgagttggtttgtcactttccaagcatgatggctagtcaagtgcacattgaccagcaattccatcaagcaggtgagacaagtttatctcagtttgtgtatcctattcccgtatttgatcaacaaaaacgcgatcaacaggaattagcgttaagagcgacacaatacgcacaacctgccattggtagcttatctgttggtttattcaatacctttaaacaagcaggatttaaagcagattttgccgcaggacatagttttggtgagttgactgcattatgggctgcagaggttatatctgaagctgactttatgaaattagcgaaggcgcgcgggcaagctatgtcggcacctgataacaatacacaaaatagtgaagcatttgaccctggcactatggcggcagtgattggaaatataagcgatattgaatcaaacattgaagcgattgaaggggtggaaattgccaattataacgcaaataatcaagctgttattgcaggtacaaccgacgcgatagcaatcgcgacaacgcaattaactgacagtggttttaaagtcatcgcattaccggtttctgctgcatttcatacaccgctagtaggccacgcgcagcaaccttttgctgaagctattgatggggttaagtttaacaaacctaagatcgcagtgtattcaaatgcgacgggtgaagcgcacagtgatgatcataatcagataaagtctgcactaaaagaacatattttacagtcagtacaattcagtaaagagattaataatttgtatgatgctggtgggcgcatatttgttgagtttggtcctaaaaatgtattaacacgattagttgataacattttaggcgataaaaatgatgtcgtaaccattgcaaccaataacaatcctaagcagtgttcagatttacaattacgcttagctgccgtgcaaatggccgtgcttggacttgaactggataatattgacccatactctgcggtagtacgccctacaatagcacctaaaaagtcaccactagcaatgaagctttctggtgcatcttatgtcagcaataaaactaaaaaagccttccaagatgaattaacagatggttggaaagtagcacaggcagtacctgtgtctgaaccacaaattaaagaagttattgttgaaaaaatagttgaaaagattgtcgaaaaaataatctacgtagacagtcaaggtaagcgtttaactgatcaatcggccgccaatattcaagaccaagctagtgctcatttagctactaatgctattaatagcattagtaataatcagcaacaattagcttctagtattgaaagcagcgtagagcagtttgttaaacatcaatcgcaacttctatctgtgcaccaagcttatttagaagggccgaatcaatacgcggatacgtttaaaacagtactagctgcgcaagcagggcaacaaaaattacctgaagggttagataaaacacttgctatgtaccatgacttccagacggaaacgttgcgtgtacacgaaacttatttaaacaatcaaaccgacaatatgcagcaaatgttgaataatgtgtcggcggttgaagtgagtgaaaacagaacaacaaactctgtatctaacttaaaaagttctatgtctaacgtaacagactcggcaacggcaaggtctactgataagtttcaacctgaaatgcaagctaatcaattccaaagtagtcaaaaggaaagtgttgcggcaaatgttaatacaaatttcagcacagccaatgatcttgatttacaacaacaactaaaagtaacacatgcaacgattcagtctcagcaagttaaacaacctgccaacgtaatagcagtcactgagacaaaggcggatgctcaagctattgaaagcattatgttgaatgtagtcgctgacaaaaccggttatcccactgaaatgttagagctaagcatggatatggaagcagatctgggcattgattcaattaaacgtgttgagatcttaggcgcagtgcaagatcaggtcactgacttaccggaattagatgctgagcagttatcacaaatgcgtaccctagcggaaattgttaactatatgcactcagtggtggtagtaaatccaatgagagagatcgttgcttcggctactgcaatacaggtcgaaacagcgaaagttgataacaatacttccctgaatctcaatgatattgaaaaagtgatgcttaacgtggtggcggataaaaccggttacccaacagaaatgctagaactgagcatggatatggaagcagatcttggcattgattcaatcaagcgtgttgagatcttaggggctgtacaggatgaaatagctgatttaccagagttagatgctgagcaattatctcaaatgcgtaccctagatgaaattgttgcttatatgcattcagtggtgatggtaaatccaatgagtgaggtcgttgcttcggctactgaaatacagctcgaaacagaaaaagttgctaacaataacgctttgaacctcaatgatattgaaacagtcatgcttagtgtggtggctgacaaaaccggctatcccgttgaaatgcttgaattaaccatggatatggaagcggatctaggcattgactcaatcaagcgtgtagagatcttaggcgcggtgcaagataaaattgttgatttgccagagttagatgctgaacagttatctcaaatgcgtactttagctgaaattgtgaattatatgcattcagtggtgatagtaaacccagtggttgacgtcgtagcttggacaccagttgttactgccacacaagttgaaatagctaaagttaccagcaaaaattccttgaaccttaatgatattgaaaaagtcatgcttagcgtggtagcggataaaaccggctacccaacagaaatgctagaactaaccatggatatggaagcggatctcggcattgattcaatcaagcgagttgagatcttaggcgcggtgcaagatgaaattgttgatttgccagagttagatgctgaacagttatcgcaaatgcgtactttagctgaaattgtgaattatatgcattcagtggtgacagtaaacccaataactaacgttgtagtttcaacaccagttgttattgccacacaagttgaaacagcgaaagctaccagtaataattccttgaacctcaatgatattgaaaaagtcatgttaaatgtggtcgctgataaaaccggctatcccgttgaaatgctggaattaaccatggatatggaagctgatttaggtattgattctatcaaacgtgtagaaattctaggggctgtgcaggatgagataactgacttaccggagttagatgcagagcaattatcacaaatgcgtaccttagatgaaattatacaatacatgcatagcgttcaatcgagtgcgatagtattgccaattttaaatgcagaaattagccctgaaaaaccattggttttagaaaatgcggcgacagaaaataatttggaaatcaattatgttattgatccgtctcctagtgcgacggtagaaataaaaaagcttgcaacacttgagtgtattaactcaagtgttgataacaagaatcttctattagttaatgatggtttaaatagctgtgtattgattgccaatgagttatctacattaggttggaatgttagtgtactgacacctgcttgggtggtagagaaaatgactaagtcctttgatcagaacattgagcgtttggttttacctgaactttgtgaaaacacattacacacattattagaatcaaaggaacagtggcagtcggttatttatctgcatcctaaaacagcagttgaagggattagctttacagaggatcataaaaaaggattacagttagcctttctgttagcgaagttaagtaaacttaacaaaataaataacgatgaccgtgtatcatttttggtgttaacacgccaaggcggtgattttgcaacgaataatatcgaacaaaaagcggatcttgtgcaaggtggattagctggtttagtgaaaacaatcgcccatgagtgggataatgtgttttgccgtattgttgatattcctagtaaatatgccgctaataaagttgccaagatagttgtcggtgaactcaatgacaaacaaatattaccggttgaagttggctttaatgaacaggggcgcctttcactagtcgccaaaagtaccgacagttatcaattacaaagtgataataagttagatgagaatagtgttttcttagtgagtggcggtgctaaaggagtgacagcacattgtgtcattgaaattgctaaacaataccagtgtaaatttattttactagggcgctcaagttatcaggctaaagaagatgattggtcacttagttatgccactgagagtgaattaaaaaaagctgctatgaaacatttgctcattacaggtgaaaaaccaagccctaagttgattaaacagttgatcgggccggtactcgctaatcgagaaataacacaaaccttacagagcattgaagctttcggaggtattgctgaatacgttagcgcggatgtttgcgaccaagaaaaccttaaagcagtgattcaaccaatttgtgatttgtggggaccgattacgggtgttatacatggcgccggtgtactagcagataaatttattgaacaaaaaacattagccgaatttgatcaggtatataacactaaaattcaagggttgaatgcattgttagcttgttgtgagttaagcacattacaacatttagtgttattttcttctgcagcgggcttttatggtaaccctggtcaatctgattacgcgattgcgaatgaaatccttaataaagcagcttaccgttttaaagatttatatccagcggcgcaggtgcttagtttcaattggggaccttggaatggtggtatggttacagcagagttgaaacgtatgttcgacgagcgtggtgtatacattattcctattcaatcgggggctacattactggccagcgagttggcggctaatagcaatcgttgtgtgcaaattgtagtcggtactgatatgtctggtaatcatgatgctttagatacgaatgatacggctgctaagcataatttgtctactcaagaatgggcgttagaggggaataatcaaacattaatcggtgttaacaaagtcgtgacaaaaacctttaatcccgataatagtttattgattgcagatcataaaattgatggtcagcaagtattaccgactgtgtgcgcgatggcttggatgcgttcaacttgtgaagccttgtatcctgattattcttatcaaagtattgaacactttaagttgttaaaaggtgttgtttttgatggtaaacaatcgatacattacttgattaatacaaccgtgatcagtgagtctgattcatccattgctattgaagtagtggttagtagtgaaaaagaacccactaaatcattttatcattatcgtgccgtattgaatttgattaaacctgattatcaacaaaatgcggagcaaataatgtatcaaggcattttaccgcagcgagtaagcaagcagtctgcacaagctaacgctttgtattcagacggtagtttattccatggtgagagtttacagggtattaaacatgtccatcaattagatgaatctggtttattaatcgaatgtgttattgaaccttcagcgctgtctgcacaaggtgaatttttattagctgacaataatgtgttagccaatgatctggtatatcaagctctgttagtgtggacaagtaaaataatggatgccggtagtttgccaactagcactgagcaatggcagttatttcgagatgtaaaagtaggtgaagatttctttataaaattgacgatcactaaacaatcaggacaatcagtgctaggcgatcttttattgattgatcaaaataatcgagtgattagtaaaataagcgcagcagaagtcacctgtagcgcaagtttacgtgagttatttaaggctagcgcttaa

SEQ ID NO: 58 - protein, 2632 aa, Artificial Sequence
  Unknown bacterial isolate SGI-i1605
  misc_feature: PfaA polypeptide
  misc_feature: SGI Peptide ID NO. 1512567
  misc_feature: Useful for modulating production of PUFA
  misc_feature (1)..(2629): NCBI GI: 119945395 Blast Desc: pfaA gene product [Psychromonas ingrahamii 37] gi|119863999|gb|ABM03476.1| polyunsaturated fatty acid synthase PfaA [Psychromonas ingrahamii 37]
  misc_feature (1)..(2627): NCBI GI: 111548647 Blast Desc: protein product [Moritella marina]
  misc_feature (1)..(2628): NCBI GI: 84387725 Blast Desc: omega-3 polyunsaturated fatty acid synthase PfaA [Vibrio splendidus 12B01] gi|84377408|gb|EAP94275.1| omega-3 polyunsaturated fatty acid synthase PfaA [Vibrio splendidus
  misc_feature (1)..(2628): NCBI GI: 325974042 Blast Desc: omega-3 polyunsaturated fatty acid synthase PfaA [Vibrio sp. NSP560]
  misc_feature (1)..(2628): NCBI GI: 218710183 Blast Desc: omega-3 polyunsaturated fatty acid synthase PfaA [Vibrio splendidus LGP32] gi|218323202|emb|CAV19379.1| PfaA, omega-3 polyunsaturated fatty acid synthase [Vibrio splendidus
  misc_feature (2)..(2628): NCBI GI: 90413869 Blast Desc: omega-3 polyunsaturated fatty acid synthase PfaA [Photobacterium profundum 3TCK] gi|90325053|gb|EAS41563.1| omega-3 polyunsaturated fatty acid synthase PfaA [Photobacterium
  misc_feature (7)..(2630): NCBI GI: 353537327 Blast Desc: polyketide-type polyunsaturated fatty acid synthase PfaA [Shewanella baltica OS625]
  misc_feature (7)..(2630): NCBI GI: 160874571 Blast Desc: polyketide-type polyunsaturated fatty acid synthase PfaA [Shewanella baltica OS195] gi|378707821|ref|YP_005272715.1| polyketide-type polyunsaturated fatty acid synthase PfaA baltica
  misc_feature (7)..(2630): NCBI GI: 371994232 Blast Desc: polyketide-type polyunsaturated fatty acid synthase PfaA [Shewanella baltica OS183] gi|373948820|ref|ZP_09608781.1| polyketide-type polyunsaturated fatty acid synthase PfaA baltica
  misc_feature (7)..(2630): NCBI GI: 217974087 Blast Desc: polyketide-type polyunsaturated fatty acid synthase PfaA [Shewanella baltica OS223] gi|217499222|gb|ACK47415.1| polyketide-type polyunsaturated fatty acid synthase PfaA baltica
  misc_feature (22)..(301): Pfam Id: PF00109 Pfam Desc: Beta-ketoacyl synthase, N-terminal domain
  misc_feature (309)..(427): Pfam Id: PF02801 Pfam Desc: Beta-ketoacyl synthase, C-terminal domain
  misc_feature (598)..(920): Pfam Id: PF00698 Pfam Desc: Acyl transferase domain
  misc_feature (1037)..(1138): Pfam Id: PF06920 Pfam Desc: Dedicator of cytokinesis
  misc_feature (1248)..(1313): Pfam Id: PF00550 Pfam Desc: Phosphopantetheine attachment site
  misc_feature (1356)..(1422): Pfam Id: PF00550 Pfam Desc: Phosphopantetheine attachment site
  misc_feature (1464)..(1529): Pfam Id: PF00550 Pfam Desc: Phosphopantetheine attachment site
  misc_feature (1575)..(1640): Pfam Id: PF00550 Pfam Desc: Phosphopantetheine attachment site
  misc_feature (1686)..(1751): Pfam Id: PF00550 Pfam Desc: Phosphopantetheine attachment site
  misc_feature (2040)..(2265): Pfam Id: PF08659 Pfam Desc: KR domain
  misc_feature (2123)..(2244): Pfam Id: PF00106 Pfam Desc: short chain dehydrogenase
MSKKQTTNPASDKRLNSRLQETPIAIVGMASVFAESKNLGQFWDTIVNSVNGIQDVPEDRWAIDDYYSADKKEADKSYCKRGAFLPEIDFDPMEFGLPPNLLELTDITQLMALVVARDVLADAGVSEESSFDRDKMGIVLGVGGGQKQGGQLMSRLQGPVLEKVLKASGLSPDDTQVIVDKFKKAYIPWEENSFPGMLGNVIAGRIANRFNFGGTNCVVDAACAGSLSAIKMAVSDLLEYRSDMMLSGGICCDNSPFMYMSFSKTPAFTDGDCIRPFDDKSNGMMIGEGVGMIALKRLEDAERDGDRIYSVIKGIGSSSDGKFKSIYAPRPEGQLKALKRAYQDAGFDPKTCGLIEAHGTGTKAGDAAEFRGLELLFSENNDQKQHVALGSVKSQVGHTKAAAGAAGLIKASLALHHKVLPATINVDKPNQNLDIENTPLYINTETRPWMQRADGAKRQAGISSFGFGGTNFHLVLEEYTQNQQGAYRLNEVAQTLLFAADNKQSLIKTLKTELASLQVDPEQQFYALNQLILSYPIKKVAEKQARCGFVAKGVEQTIKLLQQLITQLTTDQNSEWSTPTGLYYREQALPTNGKVVALFSGQGSQYVNMGRELVCHFPSMMASQVHIDQQFHQAGETSLSQFVYPIPVFDQQKRDQQELALRATQYAQPAIGSLSVGLFNTFKQAGFKADFAAGHSFGELTALWAAEVISEADFMKLAKARGQAMSAPDNNTQNSEAFDPGTMAAVIGNISDIESNIEAIEGVEIANYNANNQAVIAGTTDAIAIATTQLTDSGFKVIALPVSAAFHTPLVGHAQQPFAEAIDGVKFNKPKIAVYSNATGEAHSDDHNQIKSALKEHILQSVQFSKEINNLYDAGGRIFVEFGPKNVLTRLVDNILGDKNDVVTIATNNNPKQCSDLQLRLAAVQMAVLGLELDNIDPYSAVVRPTIAPKKSPLAMKLSGASYVSNKTKKAFQDELTDGWKVAQAVPVSEPQIKEVIVEKIVEKIVEKIIYVDSQGKRLTDQSAANIQDQASAHLATNAINSISNNQQQLASSIESSVEQFVKHQSQLLSVHQAYLEGPNQYADTFKTVLAAQAGQQKLPEGLDKTLAMYHDFQTETLRVHETYLNNQTDNMQQMLNNVSAVEVSENRTTNSVSNLKSSMSNVTDSATARSTDKFQPEMQANQFQSSQKESVAANVNTNFSTANDLDLQQQLKVTHATIQSQQVKQPANVIAVTETKADAQAIESIMLNVVADKTGYPTEMLELSMDMEADLGIDSIKRVEILGAVQDQVTDLPELDAEQLSQMRTLAEIVNYMHSVVVVNPMREIVASATAIQVETAKVDNNTSLNLNDIEKVMLNVVADKTGYPTEMLELSMDMEADLGIDSIKRVEILGAVQDEIADLPELDAEQLSQMRTLDEIVAYMHSVVMVNPMSEVVASATEIQLETEKVANNNALNLNDIETVMLSVVADKTGYPVEMLELTMDMEADLGIDSIKRVEILGAVQDKIVDLPELDAEQLSQMRTLAEIVNYMHSVVIVNPVVDVVAWTPVVTATQVEIAKVTSKNSLNLNDIEKVMLSVVADKTGYPTEMLELTMDMEADLGIDSIKRVEILGAVQDEIVDLPELDAEQLSQMRTLAEIVNYMHSVVTVNPITNVVVSTPVVIATQVETAKATSNNSLNLNDIEKVMLNVVADKTGYPVEMLELTMDMEADLGIDSIKRVEILGAVQDEITDLPELDAEQLSQMRTLDEIIQYMHSVQSSAIVLPILNAEISPEKPLVLENAATENNLEINYVIDPSPSATVEIKKLATLECINSSVDNKNLLLVNDGLNSCVLIANELSTLGWNVSVLTPAWVVEKMTKSFDQNIERLVLPELCENTLHTLLESKEQWQSVIYLHPKTAVEGISFTEDHKKGLQLAFLLAKLSKLNKINNDDRVSFLVLTRQGGDFATNNIEQKADLVQGGLAGLVKTIAHEWDNVFCRIVDIPSKYAANKVAKIVVGELNDKQILPVEVGFNEQGRLSLVAKSTDSYQLQSDNKLDENSVFLVSGGAKGVTAHCVIEIAKQYQCKFILLGRSSYQAKEDDWSLSYATESELKKAAMKHLLITGEKPSPKLIKQLIGPVLANREITQTLQSIEAFGGIAEYVSADVCDQENLKAVIQPICDLWGPITGVIHGAGVLADKFIEQKTLAEFDQVYNTKIQGLNALLACCELSTLQHLVLFSSAAGFYGNPGQSDYAIANEILNKAAYRFKDLYPAAQVLSFNWGPWNGGMVTAELKRMFDERGVYIIPIQSGATLLASELAANSNRCVQIVVGTDMSGNHDALDTNDTAAKHNLSTQEWALEGNNQTLIGVNKVVTKTFNPDNSLLIADHKIDGQQVLPTVCAMAWMRSTCEALYPDYSYQSIEHFKLLKGVVFDGKQSIHYLINTTVISESDSSIAIEVVVSSEKEPTKSFYHYRAVLNLIKPDYQQNAEQIMYQGILPQRVSKQSAQANALYSDGSLFHGESLQGIKHVHQLDESGLLIECVIEPSALSAQGEFLLADNNVLANDLVYQALLVWTSKIMDAGSLPTSTEQWQLFRDVKVGEDFFIKLTITKQSGQSVLGDLLLIDQNNRVISKISAAEVTCSASLRELFKASA

SEQ ID NO: 59 - DNA, 2874 bp, Artificial Sequence
  Unknown bacterial isolate SGI-i1605
  misc_feature: PfaB gene
  misc_feature: SGI cDNA ID NO. 1512568
  misc_feature: Encodes the peptide sequence at SEQ ID NO 60
  misc_feature: Useful for modulating production of PUFA
atgcttgctgtgatcggtctaggggggagttttgcatcagtaaaagatattgatgcattcgattaccacctatacagaaatcaatctattccattagtaaagcagggccattatgggcctgttttaactgatgccgaaagggttgttgagcagttattaacggtaaatcatttaactggcgatgatattaacttattgattgtagatgaagacaattcatctatttttcagccattactatccaatactgaattcagtactaatttttttgctgtgaatactgttttttcgattacagaggcattgaaaaaggcgcaagaagtaagttttgttgctacaaataacgacaagcttagctactctcgcactgtaaaatcaaatatcagcactgtaaacaataaagcagccatcatcctttctattaatcaacaatatttagatggtgttgctgcattattagtttgcgataaagctttacttgaacaaccactatcgcaatttcatttatgtcattgttatgctgaaattaatgcattttctactttgaattatacaaaaacttcttgtaatgatgaagtgagtgaacatatacaagattttttatcgactaatgatattaatcctgcccaggttgaatctatactcactggtgaatctgtagctgaaggttgtacaagtgaacaaaacaaagtttaccggcatcagcatcaaggcagttggctaaatgcctttcaatgtttatctgaacaacaaattcaagcatcatctggacaaaaaaaagatcaagctaagacaacattattaacggcagtagagtgtattaggactgattcggtaaacttcactgcgttagtgtcactgcttgccgctatattatgtttagatcagcgctatcgtttaggttgtaagcaaagcttgattcaaaagaaaaataaaaagcagggggcaaagcaagctgataatgaaacaccgtctataaccgcttggcaacattcacctttttactatctagcccattcgaacagttatttaagtgataaagcaaacgagggtgctaatactagacctcgtcgagtgattgtaagccatgtcggccatgtaaaagattcgacgaaagacgctaataatgctgatgctaaaaatattgacaacaatacttatattaatgggctgcttgaattaattagtgtgtccgcagcaggcataaaaaaaggtgatagttttaacataaataatggttttttagctcaacaagcgttaaaaccagtgatttttcgtgcttcaaacatgcaattattattaaagtttttaaagcaaacattattgcaagcaatggatatgatttctgcaagtcaaacattgtcatttgttgaatttgttaagcaaaaaaataatttaacttattcgattaatgctcaagtggatgctcaagataataaccaaatcaatgctagactcgcgatggatgaagatactcaggcgcagttttgtgtcgtgctgttagcgtcttcatttataacattagtggaacaaatacaattagccatcgccggtgttagcgttgcccagcaaaataacaaaccttggaagacacctgttggtagctattttagtgggcaagcagtgagtacctttaaaacgccaaaaccacttagttttatctacccaggtgtgggcgcattatacgtcaatatgggcaaagatttactgcgtttatttcctcagtgttggcaatcattatccatgctcagtgatgatcttgcacatagcttacaagatgcgttgctcacgccacgcttgatagatgaagttgattttaatatgtccttagcgctagaaaagtcgttacgtgcagaattagcgaatattgctgaggcaggcgttagttatgcgtgtttattaactaatatttttcagcaacaacttggtttaaaagcgaccagtgctgcgggttatagcatgggagaagtgagtatgtttgctgcgctagactgctggcaaacaccacagttaatgagccaacgtttcagaaatagcaaggtgtttactgagcagttatctggtccattaaaacgcttacagagcattcaaacaaacagcctagataaaattgaatttactgagcagagtagctgtactgtagtaaataaaacgccaaataaaacaagcaatactaccaacaacaaaatcgataaaagcagtgttagtccaactccagaacaacctttgtgggaatcttatcatatcaaagcggggcttttgcaggttgaatccattattgaagaattcccaagtgtttatatcactattatcaatacgccagagagtctggtcattgctggtgtgcctgaacaatgtttagcattagccaaacgattaaatttgcgtgctatcgctctgaatgtacacaacataattcactgtgagttagcaaaaagcgaatacgaaaacatgttgcagctgtattctttaccgatcaaacaaaaactaagttgccagctattttcaagttcttgttatttaccgatacctatcacgcaaaaagccattgccgtgagtattagtaaatgtttaacggaattagttgattttcctcgattaataaacaaaatagcggcatcaggtgaaacggtctttattgagatgggcgcgggtaagtccctgagtacttggattgaacgcattttaaaaaatagcactcagccaattacctgtttatcagttaaccaaaataaattagatgatcatagtgccattttaaaaaccatcgcagccttgttgagccttggttatcctattcatttacagcctttttttagtggttcattaatacgacccgttaagaagttgtctgctttagtatcagtatcatag

SEQ ID NO: 60 - protein, 957 aa, Artificial Sequence
  Unknown bacterial isolate SGI-i1605
  misc_feature: PfaB polypeptide
  misc_feature: SGI Peptide ID NO. 1512568
  misc_feature: Useful for modulating production of PUFA
  misc_feature (2)..(945): NCBI GI: 90408111 Blast Desc: heterocyst glycolipid synthase [Psychromonas sp. CNPT3] gi|90310797|gb|EAS38912.1| heterocyst glycolipid synthase [Psychromonas sp. CNPT3]
  misc_feature (49)..(949): NCBI GI: 71279011 Blast Desc: polyunsaturated fatty acid synthase PfaB [Colwellia psychrerythraea 34H] gi|71144751|gb|AAZ25224.1| polyunsaturated fatty acid synthase PfaB [Colwellia psychrerythraea 34H]
  misc_feature (266)..(896): NCBI GI: 149909574 Blast Desc: polyunsaturated fatty acid synthase PfaB [Moritella sp. PE36] gi|149807278|gb|EDM67231.1| polyunsaturated fatty acid synthase PfaB [Moritella sp. PE36]
  misc_feature (460)..(941): Pfam Id: PF00698 Pfam Desc: Acyl transferase domain
  misc_feature (481)..(935): NCBI GI: 6691655 Blast Desc: protein product [Moritella marina]
  misc_feature (487)..(952): NCBI GI: 119945396 Blast Desc: polyunsaturated fatty acid synthase PfaB [Psychromonas ingrahamii 37] gi|119864000|gb|ABM03477.1| polyunsaturated fatty acid synthase PfaB [Psychromonas ingrahamii 37]
  misc_feature (487)..(940): NCBI GI: 354568593 Blast Desc: PfaB family protein [Fischerella sp. JSC-11] gi|353539847|gb|EHC09327.1| PfaB family protein [Fischerella sp. JSC-11]
  misc_feature (490)..(939): NCBI GI: 17229135 Blast Desc: [Nostoc sp. PCC 7120] gi|17135463|dbj|BAB78009.1| all1643 [Nostoc sp. PCC 7120]
  misc_feature (490)..(940): NCBI GI: 298492363 Blast Desc: PfaB family protein ['Nostoc azollae' 0708] gi|298234281|gb|ADI65417.1| PfaB family protein ['Nostoc azollae' 0708]
  misc_feature (496)..(939): NCBI GI: 75910946 Blast Desc: beta-ketoacyl synthase [Anabaena variabilis ATCC 29413] gi|75704671|gb|ABA24347.1| Beta-ketoacyl synthase [Anabaena variabilis ATCC 29413]
  misc_feature (511)..(935): NCBI GI: 37521526 Blast Desc: glycolipid synthase [Gloeobacter violaceus PCC 7421] gi|35212523|dbj|BAC89898.1| gll1957 [Gloeobacter violaceus PCC 7421]
MLAVIGLGGSFASVKDIDAFDYHLYRNQSIPLVKQGHYGPVLTDAERVVEQLLTVNHLTGDDINLLIVDEDNSSIFQPLLSNTEFSTNFFAVNTVFSITEALKKAQEVSFVATNNDKLSYSRTVKSNISTVNNKAAIILSINQQYLDGVAALLVCDKALLEQPLSQFHLCHCYAEINAFSTLNYTKTSCNDEVSEHIQDFLSTNDINPAQVESILTGESVAEGCTSEQNKVYRHQHQGSWLNAFQCLSEQQIQASSGQKKDQAKTTLLTAVECIRTDSVNFTALVSLLAAILCLDQRYRLGCKQSLIQKKNKKQGAKQADNETPSITAWQHSPFYYLAHSNSYLSDKANEGANTRPRRVIVSHVGHVKDSTKDANNADAKNIDNNTYINGLLELISVSAAGIKKGDSFNINNGFLAQQALKPVIFRASNMQLLLKFLKQTLLQAMDMISASQTLSFVEFVKQKNNLTYSINAQVDAQDNNQINARLAMDEDTQAQFCVVLLASSFITLVEQIQLAIAGVSVAQQNNKPWKTPVGSYFSGQAVSTFKTPKPLSFIYPGVGALYVNMGKDLLRLFPQCWQSLSMLSDDLAHSLQDALLTPRLIDEVDFNMSLALEKSLRAELANIAEAGVSYACLLTNIFQQQLGLKATSAAGYSMGEVSMFAALDCWQTPQLMSQRFRNSKVFTEQLSGPLKRLQSIQTNSLDKIEFTEQSSCTVVNKTPNKTSNTTNNKIDKSSVSPTPEQPLWESYHIKAGLLQVESIIEEFPSVYITIINTPESLVIAGVPEQCLALAKRLNLRAIALNVHNIIHCELAKSEYENMLQLYSLPIKQKLSCQLFSSSCYLPIPITQKAIAVSISKCLTELVDFPRLINKIAASGETVFIEMGAGKSLSTWIERILKNSTQPITCLSVNQNKLDDHSAILKTIAALLSLGYPIHLQPFFSGSLIRPVKKLSALVSVS

SEQ ID NO: 61 - DNA, 6060 bp, Artificial Sequence
  Unknown bacterial isolate SGI-i1605
  misc_feature: PfaC gene
  misc_feature: SGI cDNA ID NO. 1512569
  misc_feature: Encodes the peptide sequence at SEQ ID NO 62
  misc_feature: Useful for modulating production of PUFA
atggaaaacatcgccatcgtaggtattgctaatttatttccagggtcgagtgcacctgaggagttttggcagcaattactaaagcaacaagataatcgaacgccaatcactgaacatgaactaggtgttaatccaaacgactatctagggcgcaagggtgaaagcgataaatattattgtttatatggcggttacattcgtgattttaactttgatggtactgaatatattactaatcaacgctcattaaatggaaggaaagcagtaactgccgatgatttaaaccagctagatgatttacatcaatggtcgctgtacgtgactaaacgtgctttgcaggatgcagggtatttgcacagtgaaaaattaaaagattgtgggttgattctaggtaacctttctttcccgaccaagcaatctaatcatctttttttagagttatatcgtgatgtggtagagcttgccttacagcaaacgattgattcaaggtttcaactgtctacttttgtacctactaaaaccgtttctccttataatgcacttgtggccggttatcccgctgctttattagctgaagttaatggtctcggtggcaattatttttccttggatgctgcttgtgcttcatcatgttatagcgtgaaattagcctgtgattatttgcaaacgggtaaagctaatatgatgttagcgggggcggtttctgctgccgattctttatttgtgaacatgggattttcaatctttcaagcttttcctgaaaataatcgacatgctccttttgatcaagattcacaaggactatttgctgcacaaggtgccggcatgatggtacttaagcgacatagtgatgccattaaagacggggatcatattcatgctgtgatcaaaggcggagctttaaccaatgatggcaaaggtgaatttgtacttagtcctaatagtaaagggcaaatattagcttatcaagaagcctataaagatgcgcagattgatccacgagaaattgattacattgaatgtcatgcaacggggactcctaaaggcgataaagttgaattaacgtctatggaacagtttttttgtcaatatcatcataaacctttacttggatctgcaaaatctaacctcggtcatttattaacggctgcaggtatgcctgcgatgacaaaagctatttatgcacttaacgagaaaatgatccctgcaaccattaatgttgataatgccattgcgactaaacagagttatttttcatcacaacagatcccgactcaaaatataagatggcctgaaacctcacattcattagatcataaacatcaaaatacagcaggtgttagtgtgtttggttttggtggtagtaatgctcacttagtgttgcaagcaggtgatagcccaaaaacagacaatacaaatcaactcaaccctgtacaaagtcttgctattgttggaatagactgccactttggttcggttgataatgcattcgattatcagcagttattaaatagcaacgaaaataactttgtggatttaccggagaaacgttggcaagggattgataaacaagcatcagtactgaatcgaatgggattacaaaaagcgcctaaagggaattatctcagtgaatttgagatagattttttgcgttttaagatcccgcctaatgatcaagatagcttgataccacaacaattattaatgatgaaggtggctgacaatgccgctaaagatgctaacttaacgccaggaagtaatgttgctgttttggtcgctatgggattagagcttgatctacaccaatatcgtggacgtgttaatctgcacagccaaattcagcaaagtttatctgcactgggagttgaattaaccgagcagcagttggccgaattgattgctatcagcaaacagagtattaacgaaccggcgcagctaaaccaatacactagttttattggtaatatcatggcttcaagaatctctgcattatgggactttagtggacctgcctttacggtttctagtgaagaaaactcggtgtataaatgcattgatattgcggataatttatttaaaacgagcgcggtcgaagcggttattattgccagtgttgatttagcgggaagtatcgaaaatatttcactgaggcaacgttttagtgcaagtgaaatgaatcctatggaaaatcgagttgctgtaaatgcacaagtacaatcccgttctgaacaacaattacagtggttagtcggagaaggcgcaggagctattgttgttaaagcaaattctgctcaggtactcgcacaagtaaaggatttagaaggtgataactcacagctcgcagactctcgagtgaacgaatctgatacagtttatgcaaatattgaagctgttaactttgcccctaatatcaatgcacagagtaatgttgagcttatttctcgtacattagcaaaagcacagatcagtgcagcacaaattacccaagttgaagcttttgccgctggtaatcaacaacaattaacagatgaacatcatgctttgactacgctttatgcaagtgcctctattgtttctagcaagcaaaagatagggcattgttataacgcatctggcatggcgagccttattgcaagtgtatttgctgttaaggacaataaacaaacagacggcgaacaaaataatgttgttctaccaagtcgttatgttgcaataaatggattaggtatggacaatagtattgcccatcttattatgtctaatgtgaacgcgactaaatttgttactaaggtaacagctaagccttctaagccaggattaattaaaacggtaaccttaggcggtaaatcaatttttgatagtatttgccaacaacaaaacaatccactcattgagcaaatacagcactcttttaataggcagtttaaagcccctgaaatggcccatttaaatgcctcaatcaatactgctaatagcagaaataatgttgaaacgatgaccgaaaaaacacaaaaaacaacaggcaatattgaaagtactgttggcgaaacagagaaacaaaaacagcatagtcaaatagtaagcccagtagtaagtaaagtagcaagccaagtaagtagtgaaattgagcaacaaagccaaactcatcaagcattcttacgtgctcgatttatggctgaaaagcagatatctaccttgatcaagctgcaggctcagcttgtaatgggtgagcaaatgccgatgactaataatgaattagttaatccagcgcacattacggcagttgagcagcctttaggtcattcaaatcagccatcaacaaacctagttggtttattgtcgattcaggggcaaagtgggtttgactatccacctttgaagttaacccccaaatataataagcctgccaatattgtttttgatactgcgcaattggtggagtttgcggaaggtaatattggtaatgtatttggtcagcagtatgccgttattgatagctataaacgcagagtacgtttgccgactacggattatttattggtaagccgagttaccgaacttagtgcacaaacgcatcaatataaaaaatcttctatgtttaccgagtatgacattcctttggatgcaccttttttaattgatggtcaaataccttggtctgtatccgtagaatctggacaatgcgatcttatgctaatttcttatattggcattgattttcagaacaaaggtgagcgtgtataccgcttattagactgtgaattaacatttttagaagagatggcttttggcggtgaaaccttgcgctatgaaattcatattgattcttatgctaaaaatggcgagcagttattgtttttcttccattacgattgttttgttggcgataaaaaagtgttaatcatgcgtaatggttgtgctggtttcttcaccgatgaggagctagcagatggaaaaggggtgattgcaacagctaatgacaaagcaaaatacgatagtgcaataaaatcatcatttagccccttaattgctaatactcaaacacaatacgattatcaatcgatgttaaaattagtgcatggtgatatcaaagggtgctttggtgatgcttatgatcaacagggacgtaacccttcattaaagttctcatctgaaaaattcttaatgattgaacgaatcactaaaattgataaaaatggggggcattggggactcggtttactagaaggtcaaaaacaattagaccctgaacattggtatttcccttgccactttaaggatgaccaagtgatggctggctcgttaatgtctgaaggttgtggccaaatggcaatgttcttcatgctctggttaggtatgaatagtcatgtcaataatgcacgttttcaaccgatggccagtgaagcgcaaacggtgcgttgccgtggtcaagttagacctcaaactaatactctgacctatagaatggaagtgactgaaattggaatgtcaccgtgtccatttatcaaagcaaatatcgatattattttggacggtaaagttgtcgtcgattttaaaaatttgtgtatggaaataaaagagcaagatcaaacaagcccttatcctgtatcccttcctaacaatgtaaatcgcgtgaataatgcaaataatatttctataaatcacttgggcgaaacctcagcactaagtggtgccgctttagggtttgaacaaggcaaatacagtgttgatcaacacagtattgatcaacatagtattgatcaacactgtatcgatgaacgaggtatcaaaccgtttctaaatacaacacgaccactgatgcgtgttgaatcagacttgagtgtaccgactaataaaggtgtcgtgccaatacaacactttgcagcaccttattttgaagggcagaatagacaaccagatacgctaccttttacgccttggcatctgtttgaatttgcaacgggaaacattagccagtgttttggacaagactttgatgtttatcaaggcagaacgccaccaagaacgccctgtggcgatttacaggtggttactaaggtcgttgatgtgcaaggtcaacgtatggactttaaaacgcctgctagctgtattgctgaatatgaggttccggaagatgcctggtatttcactaaaaatagctgtgaaaactggatgccttattcgctattaatggagattgcattacaaccaaacggatttatctctgcgtacatggggactaccctaaaatacccggaaaaagatctctattttcgcaatttagacggtcacggagagatcattaagcagatcgatttacgtggaaaaaccatcgttaataaatctgtgttgttatcaacaagcatggcaggtggtgcaatcattcaaagctttagttttgaattaagtgtcgatgcagaaacaatataccgtggtggagcagtctttggttatttcagtgcagactcattaactaatcagttgggtattgataacggacaagtaactcaaccgtggtttgttgagtataatattgcggcaactgatattacacagattgatcttacagatgatacactgagtttattcaattcatctgcacagaagccaaattatcgtttagctggtgggcaattaaactttgttgatacagtgagtattgttgaaggtggtggagatcatcaattagcttacatttatgggcaacgccacattgatgcgagtgattggttcttccgttatcatttccatcaagatcctgtaatgccaggctctttaggcgtagaagccattatcgagttgttacagtgttatgcgttaacccatgatttaggtaagcaattcagtaatcctcgttttattgcgccaacaactaaggttgcgtggaaatatcgcggacaaattacaccacttaataaacaaatgagcttggatgtgcacttaaaagagattattactagtgcatcggaagtgcgcttaataggcgatgctaacttatcaaaagatggtttgcgtatctatcaagtgaaagacattgttctgagtatcgttgaagcttaa

SEQ ID NO: 62 - protein, 2019 aa, Artificial Sequence
  Unknown bacterial isolate SGI-i1605
  misc_feature: PfaC polypeptide
  misc_feature: SGI Peptide ID NO. 1512569
  misc_feature: Useful for modulating production of PUFA
  misc_feature (1)..(2019): NCBI GI: 119945397 Blast Desc: pfaC gene product [Psychromonas ingrahamii 37] gi|119864001|gb|ABM03478.1| polyunsaturated fatty acid synthase PfaC [Psychromonas ingrahamii 37]
  misc_feature (1)..(2019): NCBI GI: 6691656 Blast Desc: protein product [Moritella marina]
  misc_feature (1)..(2019): NCBI GI: 149912083 Blast Desc: polyunsaturated fatty acid synthase PfaC [Moritella sp. PE36] gi|149804849|gb|EDM64887.1| polyunsaturated fatty acid synthase PfaC [Moritella sp. PE36]
  misc_feature (1)..(2018): NCBI GI: 90408110 Blast Desc: multi-domain beta-ketoacyl synthase [Psychromonas sp. CNPT3] gi|90310796|gb|EAS38911.1| multi-domain beta-ketoacyl synthase [Psychromonas sp. CNPT3]
  misc_feature (1)..(2019): NCBI GI: 71278985 Blast Desc: polyunsaturated fatty acid synthase PfaC [Colwellia psychrerythraea 34H] gi|71144725|gb|AAZ25198.1| polyunsaturated fatty acid synthase PfaC [Colwellia psychrerythraea 34H]
  misc_feature (2)..(285): Pfam Id: PF00109 Pfam Desc: Beta-ketoacyl synthase, N-terminal domain
  misc_feature (4)..(2019): NCBI GI: 170725782 Blast Desc: beta-hydroxyacyl-(acyl-carrier-protein) dehydratase FabA/FabZ [Shewanella woodyi ATCC 51908] gi|169811129|gb|ACA85713.1| dehydratase FabA/FabZ [Shewanella
  misc_feature (4)..(2019): NCBI GI: 157376336 Blast Desc: omega-3 polyunsaturated fatty acid synthase PfaC [Shewanella sediminis HAW-EB3] gi|157318710|gb|ABV37808.1| omega-3 polyunsaturated fatty acid synthase PfaC [Shewanella
  misc_feature (4)..(2019): NCBI GI: 212557791 Blast Desc: Multi-domain beta-ketoacyl synthase [Shewanella piezotolerans WP3]
  misc_feature (4)..(2019): NCBI GI: 325974036 Blast Desc: omega-3 polyunsaturated fatty acid synthase PfaC [Shewanella sp. MAR441]
  misc_feature (4)..(2019): NCBI GI: 90413867 Blast Desc: omega-3 polyunsaturated fatty acid synthase PfaC [Photobacterium profundum 3TCK] gi|90325051|gb|EAS41561.1| omega-3 polyunsaturated fatty acid synthase PfaC [Photobacterium
  misc_feature (293)..(408): Pfam Id: PF02801 Pfam Desc: Beta-ketoacyl synthase, C-terminal domain
  misc_feature (481)..(763): Pfam Id: PF00109 Pfam Desc: Beta-ketoacyl synthase, N-terminal domain
  misc_feature (799)..(886): Pfam Id: PF02801 Pfam Desc: Beta-ketoacyl synthase, C-terminal domain
  misc_feature (1385)..(1518): Pfam Id: PF07977 Pfam Desc: FabA-like domain
  misc_feature (1877)..(2010): Pfam Id: PF07977 Pfam Desc: FabA-like domain
MENIAIVGIANLFPGSSAPEEFWQQLLKQQDNRTPITEHELGVNPNDYLGRKGESDKYYCLYGGYIRDFNFDGTEYITNQRSLNGRKAVTADDLNQLDDLHQWSLYVTKRALQDAGYLHSEKLKDCGLILGNLSFPTKQSNHLFLELYRDVVELALQQTIDSRFQLSTFVPTKTVSPYNALVAGYPAALLAEVNGLGGNYFSLDAACASSCYSVKLACDYLQTGKANMMLAGAVSAADSLFVNMGFSIFQAFPENNRHAPFDQDSQGLFAAQGAGMMVLKRHSDAIKDGDHIHAVIKGGALTNDGKGEFVLSPNSKGQILAYQEAYKDAQIDPREIDYIECHATGTPKGDKVELTSMEQFFCQYHHKPLLGSAKSNLGHLLTAAGMPAMTKAIYALNEKMIPATINVDNAIATKQSYFSSQQIPTQNIRWPETSHSLDHKHQNTAGVSVFGFGGSNAHLVLQAGDSPKTDNTNQLNPVQSLAIVGIDCHFGSVDNAFDYQQLLNSNENNFVDLPEKRWQGIDKQASVLNRMGLQKAPKGNYLSEFEIDFLRFKIPPNDQDSLIPQQLLMMKVADNAAKDANLTPGSNVAVLVAMGLELDLHQYRGRVNLHSQIQQSLSALGVELTEQQLAELIAISKQSINEPAQLNQYTSFIGNIMASRISALWDFSGPAFTVSSEENSVYKCIDIADNLFKTSAVEAVIIASVDLAGSIENISLRQRFSASEMNPMENRVAVNAQVQSRSEQQLQWLVGEGAGAIVVKANSAQVLAQVKDLEGDNSQLADSRVNESDTVYANIEAVNFAPNINAQSNVELISRTLAKAQISAAQITQVEAFAAGNQQQLTDEHHALTTLYASASIVSSKQKIGHCYNASGMASLIASVFAVKDNKQTDGEQNNVVLPSRYVAINGLGMDNSIAHLIMSNVNATKFVTKVTAKPSKPGLIKTVTLGGKSIFDSICQQQNNPLIEQIQHSFNRQFKAPEMAHLNASINTANSRNNVETMTEKTQKTTGNIESTVGETEKQKQHSQIVSPVVSKVASQVSSEIEQQSQTHQAFLRARFMAEKQISTLIKLQAQLVMGEQMPMTNNELVNPAHITAVEQPLGHSNQPSTNLVGLLSIQGQSGFDYPPLKLTPKYNKPANIVFDTAQLVEFAEGNIGNVFGQQYAVIDSYKRRVRLPTTDYLLVSRVTELSAQTHQYKKSSMFTEYDIPLDAPFLIDGQIPWSVSVESGQCDLMLISYIGIDFQNKGERVYRLLDCELTFLEEMAFGGETLRYEIHIDSYAKNGEQLLFFFHYDCFVGDKKVLIMRNGCAGFFTDEELADGKGVIATANDKAKYDSAIKSSFSPLIANTQTQYDYQSMLKLVHGDIKGCFGDAYDQQGRNPSLKFSSEKFLMIERITKIDKNGGHWGLGLLEGQKQLDPEHWYFPCHFKDDQVMAGSLMSEGCGQMAMFFMLWLGMNSHVNNARFQPMASEAQTVRCRGQVRPQTNTLTYRMEVTEIGMSPCPFIKANIDIILDGKVVVDFKNLCMEIKEQDQTSPYPVSLPNNVNRVNNANNISINHLGETSALSGAALGFEQGKYSVDQHSIDQHSIDQHCIDERGIKPFLNTTRPLMRVESDLSVPTNKGVVPIQHFAAPYFEGQNRQPDTLPFTPWHLFEFATGNISQCFGQDFDVYQGRTPPRTPCGDLQVVTKVVDVQGQRMDFKTPASCIAEYEVPEDAWYFTKNSCENWMPYSLLMEIALQPNGFISAYMGTTLKYPEKDLYFRNLDGHGEIIKQIDLRGKTIVNKSVLLSTSMAGGAIIQSFSFELSVDAETIYRGGAVFGYFSADSLTNQLGIDNGQVTQPWFVEYNIAATDITQIDLTDDTLSLFNSSAQKPNYRLAGGQLNFVDTVSIVEGGGDHQLAYIYGQRHIDASDWFFRYHFHQDPVMPGSLGVEAIIELLQCYALTHDLGKQFSNPRFIAPTTKVAWKYRGQITPLNKQMSLDVHLKEIITSASEVRLIGDANLSKDGLRIYQVKDIVLSIVEA

SEQ ID NO: 63 - DNA, 1656 bp, Artificial Sequence
  Unknown bacterial isolate SGI-i1605
  misc_feature: PfaD gene
  misc_feature: SGI cDNA ID NO. 1512447
  misc_feature: Encodes the peptide sequence at SEQ ID NO 64
  misc_feature: Useful for modulating production of PUFA
atgacacaagcaactaataaagcagcacttatcgagatcaataaacagcaaattgattggaattggcaagtcgcagcctcaacattaagcgatgaccctgttagcctaaaaaaagcattattagccactgataagccgttatatttagctaaactgaataatgagattgcagtaactcatcaacttatgagccatcaagaggatgtacaacctgagtcagcttctgttttaccagtactggcttttgctcaatcgattaaagcagaggaacttggttctgcagagtttaaaaaagcacatggcgttaaatatgcctatcacggcggggcgatggcgaatggtattgcctctgtggaattggtaattgcgctaggtaaagctggcttgctatgttcatttggcgctgctggccttattccagacgtcattgaagagtcaattaaacggattcaagtcgctttacctaacggaccttttgcggttaatttaattcattcccctagcgaaccggcattagagtctggtgctgtagagcgatttttgaaactaggtgttaacaccgttgaagcttccgcatttttagctttaacagaacacattgtacattatagagtcgcaggtctttcacaaaatccagatggcagtattgcgattaaaaataaagtcattgcaaaagtgtctcgtactgaagttgctgaacgttttatgtcacctgcaccgcaaaagtttttaacaaaactacttactgcggggaaaattactgcattacaagcagagctcgcactgcaggtaccaatggctgacgatataacagctgaagctgattctggtgggcacacggataatcgcccctttttaactttgttaccgacaattctaaaacagcgagatcaacttcaagccaagtataactatgtgacgccactgcgtgttggtgcgggtggagggataggaacccccgagtctgcgcttgctgcattcaatatgggcgcagcttatattgtgttaggctctgtcaatcaagcctgtgtagaagcaggggcgtcagaacataccagaaagttattggcgaatatagagatggccgatgtcaccatggcacccgctgcagatatgtttgaaatgggggttaagcttcaagttgtaaaacgtggctcaatgtttgccatgcgtgcgaataaactttatgagttatacagtaactaccctagtatcgaagcattaccggcacttgagcgagagaaagtagagaaacaaatcttccgtcaaaacctcgaccaagtttgggatattaccaaagcctttttccatgagcgtgaccctgacatgttagcaagagcattgaatgacccaaaacgtaaaatggcacttatttttcgttggtatttaggattgtcatctcgttggtctaatattggtgaaaaggggcgtgaaatggactatcaaatatgggctggaccgagtttgggcgcctttaacagttgggtaaaagacagttatttagtcgattaccaacaacgtaatgcagtcgatgtagcactacatttattaactggtgcggcatatttagaacgtatcaatcaactcaaataccaaggtgtgacagtacacaacagtttattaaattatcatccggcacattcttttttatcttaa

SEQ ID NO: 64 - protein, 551 aa, Artificial Sequence
  Unknown bacterial isolate SGI-i1605
  misc_feature: PfaD polypeptide
  misc_feature: SGI Peptide ID NO. 1512447
  misc_feature: Useful for modulating production of PUFA
  misc_feature (9)..(543): NCBI GI: 90408109 Blast Desc: PCNPT3_08200 [Psychromonas sp. CNPT3] gi|90310795|gb|EAS38910.1| PCNPT3_08200 [Psychromonas sp. CNPT3]
  misc_feature (14)..(544): NCBI GI: 71281382 Blast Desc: polyunsaturated fatty acid synthase PfaD [Colwellia psychrerythraea 34H] gi|71147122|gb|AAZ27595.1| polyunsaturated fatty acid synthase PfaD [Colwellia psychrerythraea 34H]
  misc_feature (14)..(544): NCBI GI: 149912082 Blast Desc: polyunsaturated fatty acid synthase PfaD [Moritella sp. PE36] gi|149804848|gb|EDM64886.1| polyunsaturated fatty acid synthase PfaD [Moritella sp. PE36]
  misc_feature (14)..(545): NCBI GI: 127513596 Blast Desc: 2-nitropropane dioxygenase [Shewanella loihica PV-4] gi|126638891|gb|ABO24534.1| 2-nitropropane dioxygenase, NPD [Shewanella loihica PV-4]
  misc_feature (17)..(546): NCBI GI: 119945398 Blast Desc: pfaD gene product [Psychromonas ingrahamii 37] gi|119864002|gb|ABM03479.1| polyunsaturated fatty acid synthase PfaD [Psychromonas ingrahamii 37]
  misc_feature (20)..(545): NCBI GI: 119774249 Blast Desc: omega-3 polyunsaturated fatty acid synthase PfaD [Shewanella amazonensis SB2B] gi|119766749|gb|ABL99319.1| omega-3 polyunsaturated fatty acid synthase PfaD [Shewanella amazonensis
  misc_feature (20)..(547): NCBI GI: 167624925 Blast Desc: PfaD family protein [Shewanella halifaxensis HAW-EB4] gi|167354947|gb|ABZ77560.1| PfaD family protein [Shewanella halifaxensis HAW-EB4]
  misc_feature (20)..(547): NCBI GI: 212557792 Blast Desc: Polyunsaturated fatty acid synthase PfaD [Shewanella piezotolerans WP3]
  misc_feature (20)..(547): NCBI GI: 157962729 Blast Desc: PfaD family protein [Shewanella pealeana ATCC 700345] gi|157847729|gb|ABV88228.1| PfaD family protein [Shewanella pealeana ATCC 700345]
  misc_feature (36)..(544): NCBI GI: 6691657 Blast Desc: protein product [Moritella marina]
  misc_feature (96)..(376): Pfam Id: PF03060 Pfam Desc: Nitronate monooxygenase
MTQATNKAALIEINKQQIDWNWQVAASTLSDDPVSLKKALLATDKPLYLAKLNNEIAVTHQLMSHQEDVQPESASVLPVLAFAQSIKAEELGSAEFKKAHGVKYAYHGGAMANGIASVELVIALGKAGLLCSFGAAGLIPDVIEESIKRIQVALPNGPFAVNLIHSPSEPALESGAVERFLKLGVNTVEASAFLALTEHIVHYRVAGLSQNPDGSIAIKNKVIAKVSRTEVAERFMSPAPQKFLTKLLTAGKITALQAELALQVPMADDITAEADSGGHTDNRPFLTLLPTILKQRDQLQAKYNYVTPLRVGAGGGIGTPESALAAFNMGAAYIVLGSVNQACVEAGASEHTRKLLANIEMADVTMAPAADMFEMGVKLQVVKRGSMFAMRANKLYELYSNYPSIEALPALEREKVEKQIFRQNLDQVWDITKAFFHERDPDMLARALNDPKRKMALIFRWYLGLSSRWSNIGEKGREMDYQIWAGPSLGAFNSWVKDSYLVDYQQRNAVDVALHLLTGAAYLERINQLKYQGVTVHNSLLNYHPAHSFLS

SEQ ID NO: 65 - DNA, 840 bp, Artificial Sequence
  Unknown bacterial isolate SGI-i1605
  misc_feature: PfaE polypeptide
  misc_feature: SGI cDNA ID NO. 1512488
  misc_feature: Encodes the peptide sequence at SEQ ID NO 66
  misc_feature: Useful for modulating production of PUFA
atgttgcccttacctaacaaggtctactcagtggatacatttatttcaaatttacatgccttaaaaactaatcatattgatttatggtctattgaccctaccaagttgtgtcaacaatcaatcacatttttaactagtctgttaacaacagaagaatctgaaaaattattaaaatataagcataaagaagctcaacatattgccttaattacacgctcattatgccgcttagtcttatcccactatacaaactgttcgcccgccgcattagaatttgtccgtaattcacagggtaaacctgccctagttaataacaacaatgatatacgttttaatctaagccataataatcaactcattattatggctgtatgtgctggggatgaagttggttgtgatattgaagatccgctgcgtaaagttaatattgcgacgataactaaacgttattttgcagcacaagaacataaacagttaagtgaattaacaggagtggaacaacagcaacaattttttagatgttggacattgaaagaagctttcgttaaagcaacgggtgtagggattagtttgggtttagatacattttattttagctttaccagtaccaccacaggtaaccaaagtgatccatcaaaaacagtggctaaaaaaactcaacaattgaatttaaaggataacattgcaatacatttcaattcacattatcccttgagcaaagatacgccgtggcagttttatcacactttttttaaacaacaaaccatgtcaatctgtcgtgcgagtaaacttaatcaaactattatttatcgcgatgcgacttcattacttggcatttaa

SEQ ID NO: 66 - protein, 279 aa, Artificial Sequence
  Unknown bacterial isolate SGI-i1605
  misc_feature: PfaE polypeptide
  misc_feature: SGI Peptide ID NO. 1512488
  misc_feature: Useful for modulating production of PUFA
  misc_feature (1)..(277): NCBI GI: 192358911 Blast Desc: mtaA gene product [Cellvibrio japonicus Ueda107] gi|190685076|gb|ACE82754.1| HetI [Cellvibrio japonicus Ueda107]
  misc_feature (17)..(221): NCBI GI: 90408179 Blast Desc: 4'-phosphopantetheinyl transferase superfamily protein [Psychromonas sp. CNPT3] gi|90310709|gb|EAS38826.1| 4'-phosphopantetheinyl transferase superfamily protein sp. CNPT3]
  misc_feature (20)..(246): NCBI GI: 108759439 Blast Desc: 4'-phosphopantetheinyl transferase [Myxococcus xanthus DK 1622] gi|108463319|gb|ABF88504.1| 4'-phosphopantetheinyl transferase [Myxococcus xanthus DK 1622]
  misc_feature (21)..(268): NCBI GI: 119946351 Blast Desc: 4'-phosphopantetheinyl transferase [Psychromonas ingrahamii 37] gi|119864955|gb|ABM04432.1| 4'-phosphopantetheinyl transferase [Psychromonas ingrahamii 37]
  misc_feature (21)..(271): NCBI GI: 149911207 Blast Desc: 4-phosphopantetheinyl transferase [Moritella sp. PE36] gi|149805734|gb|EDM65732.1| 4-phosphopantetheinyl transferase [Moritella sp. PE36]
  misc_feature (21)..(200): NCBI GI: 112181143 Blast Desc: 4'-phosphopantetheinyl transferase [Moritella marina]
  misc_feature (21)..(203): NCBI GI: 71282200 Blast Desc: 4-phosphopantetheinyl transferase [Colwellia psychrerythraea 34H] gi|71147940|gb|AAZ28413.1| 4-phosphopantetheinyl transferase [Colwellia psychrerythraea 34H]
  misc_feature (21)..(209): NCBI GI: 119476927 Blast Desc: 4-phosphopantetheinyl transferase [marine gamma proteobacterium HTCC2143] gi|119449734|gb|EAW30971.1| 4-phosphopantetheinyl transferase [marine gamma proteobacterium
  misc_feature (21)..(202): NCBI GI: 383456608 Blast Desc: hetI gene product [Corallococcus coralloides DSM 2259] gi|380733042|gb|AFE09044.1| 4-phosphopantetheinyl transferase [Corallococcus coralloides DSM 2259]
  misc_feature (21)..(231): NCBI GI: 84387726 Blast Desc: 4'-phosphopantetheinyl transferase family protein [Vibrio splendidus 12B01] gi|84377409|gb|EAP94276.1| 4'-phosphopantetheinyl transferase family protein [Vibrio 12B01]
  misc_feature (130)..(192): Pfam Id: PF01648 Pfam Desc: 4'-phosphopantetheinyl transferase superfamily
MLPLPNKVYSVDTFISNLHALKTNHIDLWSIDPTKLCQQSITFLTSLLTTEESEKLLKYKHKEAQHIALITRSLCRLVLSHYTNCSPAALEFVRNSQGKPALVNNNNDIRFNLSHNNQLIIMAVCAGDEVGCDIEDPLRKVNIATITKRYFAAQEHKQLSELTGVEQQQQFFRCWTLKEAFVKATGVGISLGLDTFYFSFTSTTTGNQSDPSKTVAKKTQQLNLKDNIAIHFNSHYPLSKDTPWQFYHTFFKQQTMSICRASKLNQTIIYRDATSLLGI

SEQ ID NO: 67 - DNA, 7971 bp, Artificial Sequence
  Unknown bacterial isolate SGI-i1607
  misc_feature: PfaA gene
  misc_feature: SGI cDNA ID NO. 1557019
  misc_feature: Encodes the peptide sequence at SEQ ID NO 68
  misc_feature: Useful for modulating production of PUFA
gtggcctacttttggcaaccttactcttcagctgcgtttgcccaagtctgtttcagatttattttcgatccatttagaaacgcagcctcaaaacacgacatcgccctcagtgatttcaagtggagactcataatgagccaacccgaaaaaaatacaccggaatcagtcgacgacactcgactcaataaacgccttaaagatatgccagttgctatcgttggtatggcaagcatgtttgcgaactcccgttacttaaataagttctgggatctgatcagtgaaaagatcgatgcaattaccgaagtaccagatacgcactggcgtccagaagattactacgatgcagatcgtactacgccagacaagtcttactgtaagcgcggtggtttcatccctgaagtggacttcaacccaatggagttcggccttccgccaaatatcctagaactgactgatacatcacagctgctttctctgatcgttgcaaaagaagtacttgaagatgccaagctgcctgaaggctacgatcgcgataagatcggtatcacgctcggtgttggtggtggtcaaaagatcgctcaaagcctaaatgcacgtcttcaataccctgttttgaaaaaagtcttcaagagcagtggtatcagcgacgacgacagcgaaatgctgatcaaaaaattccaagaccaatacatccactgggaagaaaactcattccctggttcattgggtaacgtaatttcaggtcgtattgctaaccgctttgaccttggtggcatcaactgtgtagtagatgctgcgtgtgcgggctctctagccgcaatgcgtatggctcttagtgagctggttgaaggccgcagtgaaatgatgatcacaggtggtgtgtgtactgataactcgccaaccatgtacatgagcttctctaaaacacctgcatttaccaccaatgaaaccattcaacctttcgacatcgactcaaaaggcatgatgattggtgaaggtatcggcatggttgctcttaagcgtcttgaagatgcagagcgcgacggcgacagaatctactcagtgattaaaggtgtcggttcttcttcggatggtaagttcaagagtatttacgcccctcgccctgaaggacaagcaaaagcactaaaacgcgcttacgatgatgctggtttcgcaccgcacacacttggccttttagaagcgcacggcacaggtacagctgcgggtgatgttgctgaatttggcggcttaaactcggtattcagtgagaacaatgaagagaagcaacacattgcgttaggctctgtgaaatctcaaattggtcacaccaaatcaaccgcgggtactgcaggtttaatcaaagctgcattagcactacaccacaaagtactgccgccaacgatcaacgtatcggctccgaatcctaaactggatatcgagaattcaccgttctacctaaacacacaaacgcgcccttggatgaaacgtgtcgacggcacaccacgccgtgcaggtatcagctcatttggttttggtggcactaacttccacgttgtattggaagaatacacaccagaacacgctcgcggtgacaagtaccgtcagcgccaagtaccacaaaccctgttattcggcgcggaatctcgtcaagcactgatcaatgagctcaagcaggtttcaactcaagctgcagacgctgcgttcaaactggaaacgcttgctgagcaacacgctctacgcgaagttgacgctaagcatgctcgtattggtttagtcgtgactgaccaagcagaccttcaagcgcaactgactcaagcggtttctatgcttgagagccaaaccaaagcacattggcagatgccaaacggtactagctaccgtgagtcggcactgattgctgaaaacggtgcttgtaaagtggctgcattatttgctggtcaaggttcacaatacctaaacatgggtcgcgagcttgcttgtcattacccagaaatgcgccaacagcttgctcaagcggatcaagtatttggtcagcacaagaaaacggctctgtcgcaaattctgttcccaattccaaccttcacatcagaagcaaccaaagctcaagaagctgtgctaaccaacacggccaacgcgcaaagtgcgattggtactgtgtctatgggtcagttcgacatcatgactcaagcaggcttcaaagcagacatggtcgcaggccacagctttggtgagctaagcgcactatgtgcatcgggtgttatctcgcaagacgattactaccagttagctttcgctcgtggcgatgcgatggcagcgacacctgaacaaggtgacagcggtactatgtttgcggtcatcttagacgcagacaaacttccagccgttgaaagctgcatcagccaattcgaaggcgtgagcattgccaattacaacgctccgactcaactggttattgcaggtccaactgcgacggttcaacaagcagcacaagcgttaacagaacaaggcttcaaagcgattgctctgcctgtttctggcgcgttccacacaccgcttgttgctcacgctcaaaaaccatttgctgctgcaattgataaagcttcattcagcgctccaacgctgccgctttactcaaacgcaacgggcaaactgcacagcaaagacgcgaaagcaatcaagaaagcattcaagcaacacatgctgcaatcggttcgtttcagcgagcaaattgaagcgatgtatgaagcaggcgcgcgtgtattcgttgagttcggtccgaaaaacattcttcaaaagctggttgagaaaacattggctgataagaacgaagagctttacgcaatcagcatcaacccaagccctaaaggcgacagtgaccaacaacttcgcttagctgcggttcaactgtgcgtggctggtgtttcattagacaacattgacccttaccaagctgacattgctgaacctgcaaaggcatcaccaatgaacatcaagctgaatgcaaccaactacatcagccctgctactcgtaagaaaatggatcaatcattagcttcgggcaacgtcaccgaaaagactgagattgttgaagtgaaagttgaagtcgagaaaatcgtggaaaaagaagtgattaaaacagaaatcgttgaagtacctgtggctgctcctcaagcttcaaatgtacaacaatcagttgcagcaccaagtgtacaagtagcaacagcaactcagcagcctcaagtggcgcaacctgcaccagcgactattcaaccaacagcttcagtaacggttgatgagtcttcactgcaatcattcttcaatgctcaacaacaagcagcagaagtacatcagcagttccttgcgattcctcagcaatacggtgacacgttcaacaccctaatgtctgagcaagcgaaaatggcaacagcaggcgtagcaattcctgagaacctacagcgttctatggagatgttccaccagcaccaagctgaaacgctaaaagctcacgctcattacctagaaatgcaagcgcacagcaacaactcagcactcaatatgctgacgcaaggttcagtactaacggcacaaccaaccttcgttgcgtctgtaaatgctcagccagcgattcaagctactccaacagctatcgttcaacagcctgtagctcaagtacaagcgactcctgtacaagctcagtctgttcaagctgcgccggttcaaaatacaacaactcagcaagctccaatacagaaagcagctcctgcgccacaagtagcggctcaggccgcagcgcctgcagctcaacctgtgccagttaaaacgcaaccggctcctgtggctgcaccagtagcagtacaatcagcagatgctgaaaaagtgatgctagaagtggtcgctaagaaaacgggctacccaacggaaatgcttgatctagaaatggacatggaagcagaccttggtatcgactcaatcaaacgcgtagagattcttggtaccgttcaagacgaaatgccaaacctacctgagctgaaccctgaagatttagctgagtgtcgtactcttggcgaaatcgttacttacatgaacagcaagatgcctgcatcagcgcctgttgcagcgcagccaagcgcaaccgctcctgttcaagcagctaacggtcttgatgcaaaagtcgttcaacaaaccatgctagaagtggttgctgagaagaccggttacccaactgaaatgcttgatctagaaatggatatggaagcagaccttggtatcgactcaatcaagcgtgttgaaattcttggtacggttcaagatgagctgcctactcttccagagctaaaccctgaagacttagctgagtgtcgcactcttggcgagattgttgactacatgaacagcaaacttccggcttcggctcctgcagtagctcaacctgcagcaacttcagttcaagcagttagcggactagatgctgctgtcgttcaaaaaaccatgttagaagtggtagcagaaaagacgggctacccgactgaaatgctagacctagcaatggatatggaagctgaccttggtatcgattcaatcaagcgtgttgaaattctaggtacggtacaagacgaattaccgactcttccagagctaaaccctgaagatttggctgagtgtcgtactcttggcgagatagtcgactacatgaacagtaagcttccagcttctgctcctgtagcagctcaaatatctgcaccagcgcaagcagtatcaaacggtttaaacgcagaacaagttcaaggcacaatgctgagcgtagtggctgataaaacgggctacccaacagaaatgctcgacctagcaatggacatggaagctgaccttggcatcgactcaatcaaacgtgttgagatccttggtacggttcaagaccagctaccaacattgccagagctgaatcctgaagacctagctgagtgtcgtactctgggtgagattgttgactacatgaacagcaagttagctcctagttcggaagcagcgacagtagctcctgctgcagaagtagaggcaattgtagaaagcgcaagcaacgacctaaaccctgctcatgttcaatcaacaatgatggaagtggttgccgacaaaacaggttacccagcagaaatgctcgacctagcgatggacatggaagcagaccttggtatcgactcaatcaaacgtgttgagattctaggtacggttcaagaccagctaccaacgctgccagagctaaaccctgaagacttagctgagtgtcgtactcttggtgaaatcgttacctacatgcaaagcaagctatccgctgctgcacccgtagcgactccaaaagctgaatcagtaacgcctatcgcagaaacagcgacagcggaacttcctccacacaatgaggtggcgctaaaaaagctaccagcggcagataaactcgtcgattgtttctcaaaagacgcttgtgtcgtgatcacagatgatggtcacaacgccggtgttctagcagaaaagttgaccgctaacggcattcaagttgccgtagtgcgtagtgccctttctgccgcgtcacctttaaacagtgaaatcgcaagctacacactcaacagcgtcgatgatgctggtgtgactgcagttattaacgacatcgaagcagacctggaaacgtcgaacaaagtgattgctggcttcattcatttacaagctatcgttgatgctaaacaaagcaacgagcaagcggttaacttgaatgcagactcaagaacttcgctaaccacagcgttcttattcgccaagcacctaaatggccaactgaatgccgtttctggtcgtagtgtgttcttcacactaagccgtatcgatggtggctttggttacctagatactaagcaattgatgaatgcggaacttaaccaagccgcgctgtctggtctaactaagacactaagccatgaatggccaaacgtgttctgccgcgcattggatgctgacgcttcgattgatgctcgtcacctagctgaagctatcacaggcgaactgttcgatatcgataccaacacggttgaaatcggccttagccatgcagaaaacggtgaatctggtcgtgcaacattgattgctgcaacaccaggcgctgcacaaactaaaaacacaggcgctcaactcaccaagaacgacaaggttctcgtaactggtggcgctaaaggcgtgacgtttgaatgtgcactgacacttgctaagcaatgtaagtctcatttcattcttgcaggtcgtagtaagcatattacttccgctgagctacctcagtgggcacagggcaagcaagagaaagaactaaaaccagcagctatcgcccacctccaagcaacaggtgacaaaccaacgccgaagaaagttgataccttgctaaaaccggtattgagcagccttgaaatcaacgcagcacttgccgctttcaacgagattggcgcaagcgctgagtacctaagcttagatgtgtcgaaccatgagtcggtagcgaaaacgctggcgaatttcgaaggcatcacaggtcttatccacggtgcaggcgtgctggcggacaaacacattcaagacaaaacgcttgatgagctaaacatggtttacggcacgaaagtgggcggactagaagcggttcttagtggtcttgatagcagcaagctaaaactgattgcgatgttctcttcggcggcgggtttctatggaaacactggccaaagtgattactcgatgtctaacgagatcctaaacaaagcggctctacaactatctgctcgtaaccctcaagcgaaagtgatgagcttcaattggggaccgtgggacggtggcatggtaaacgcagcactgaaacgtatgttcacagaacgtggtgtgtacgtaattcctcttcaagcaggtgcagagctgtttagctctcaactactgaacgaaactggcattcaattgctggttggtacgagcatgcaaggttctgacaacaaggaagctgctgtaaaaaagcttaatgcggagtctgtgcatcttgcaaagagtccgctgaatacaagcatcactgtgacacgtcatcttgatccaaaggcattgcctttcattcaagatcactgcattgccggtaacccagtgttaccgacagtgtgtgccatccaatggatgcgtgaagtggcagagcaactgttaggggtgaacgttagcgttcacaactacaaactgcttaagggtgtgatttttgatactgatgaagtgcaagagctgaatctggttctttcttctgatgctaaatcaaaagatcagctaaaagcggtgatcagttgccaagggcgaccacagtatcaagctcagttgcaagttgcctctgtgcaagtgtctgaagatgttcaacaagcgtcagtaaaacgctttgaggccaacacttcagcacctgtaacaacggcacaagctctatacagtgacggtactctgtttcatggaccaagattgcaaggtattacctcagtcgaacgctttgacgacttaggcttattggctcaatgccagttgcctcagattgaaaacagcgactgcggatcatttattcctaagcaaggctttggtgatagccagccatttgctgaagattatctgttgcaagcaatgctggtatgggctcgattgaaatacggcgcggcaagcctaccgtctgcaatcggtgagtttatttgttacgcaccgatgcacaatggtggccaaggttggctagagctgagcgtgataaaaagcacggctcgttcgctgcaagctgatatctcgctttaccaccaagatggtcgtttaagcgcagtaatgaaaggtgcaaaagtcaccatcagcaagagcttaaacgacgcatttttgccgaagtctagctcagcagtatcgaagaaagaggcgactaagaacccagaaaaggagcaattgtcatag

SEQ ID NO: 68 - protein, 2656 aa, Artificial Sequence
  Unknown bacterial isolate SGI-i1607
  misc_feature: PfaA polypeptide
  misc_feature: SGI Peptide ID NO. 1557019
  misc_feature: Useful for modulating production of PUFA
  misc_feature (40)..(2656): NCBI GI: 54308653 Blast Desc: omega-3 polyunsaturated fatty acid synthase PfaA [Photobacterium profundum SS9] gi|46913082|emb|CAG19871.1| omega-3 polyunsaturated fatty acid synthase PfaA [Photobacterium
  misc_feature (44)..(2656): NCBI GI: 90413869 Blast Desc: omega-3 polyunsaturated fatty acid synthase PfaA [Photobacterium profundum 3TCK] gi|90325053|gb|EAS41563.1| omega-3 polyunsaturated fatty acid synthase PfaA [Photobacterium
  misc_feature (45)..(2656): NCBI GI: 86147635 Blast Desc: omega-3 polyunsaturated fatty acid synthase PfaA [Vibrio sp. MED222] gi|85834546|gb|EAQ52695.1| omega-3 polyunsaturated fatty acid synthase PfaA [Vibrio sp. MED222]
  misc_feature (45)..(2656): NCBI GI: 84387725 Blast Desc: omega-3 polyunsaturated fatty acid synthase PfaA [Vibrio splendidus 12B01] gi|84377408|gb|EAP94275.1| omega-3 polyunsaturated fatty acid synthase PfaA [Vibrio splendidus
  misc_feature (45)..(2656): NCBI GI: 325974042 Blast Desc: omega-3 polyunsaturated fatty acid synthase PfaA [Vibrio sp. NSP560]
  misc_feature (45)..(2656): NCBI GI: 218710183 Blast Desc: omega-3 polyunsaturated fatty acid synthase PfaA [Vibrio splendidus LGP32] gi|218323202|emb|CAV19379.1| PfaA, omega-3 polyunsaturated fatty acid synthase [Vibrio splendidus
  misc_feature (45)..(2656): NCBI GI: 15488031 Blast Desc: AF409100_7 omega-3 polyunsaturated fatty acid synthase PfaA [Photobacterium profundum SS9]
  misc_feature (45)..(2656): NCBI GI: 325974052 Blast Desc: omega-3 polyunsaturated fatty acid synthase PfaA [Photobacterium sp. MA665]
  misc_feature (45)..(2656): NCBI GI: 325974032 Blast Desc: omega-3 polyunsaturated fatty acid synthase PfaA [Shewanella sp. MAR441]
  misc_feature (54)..(2634): NCBI GI: 353537327 Blast Desc: polyketide-type polyunsaturated fatty acid synthase PfaA [Shewanella baltica OS625]
  misc_feature (68)..(345): Pfam Id: PF00109 Pfam Desc: Beta-ketoacyl synthase, N-terminal domain
  misc_feature (353)..(470): Pfam Id: PF02801 Pfam Desc: Beta-ketoacyl synthase, C-terminal domain
  misc_feature (643)..(950): Pfam Id: PF00698 Pfam Desc: Acyl transferase domain
  misc_feature (1294)..(1360): Pfam Id: PF00550 Pfam Desc: Phosphopantetheine attachment site
  misc_feature (1395)..(1463): Pfam Id: PF00550 Pfam Desc: Phosphopantetheine attachment site
  misc_feature (1497)..(1564): Pfam Id: PF00550 Pfam Desc: Phosphopantetheine attachment site
  misc_feature (1599)..(1665): Pfam Id: PF00550 Pfam Desc: Phosphopantetheine attachment site
  misc_feature (1705)..(1770): Pfam Id: PF00550 Pfam Desc: Phosphopantetheine attachment site
  misc_feature (2065)..(2286): Pfam Id: PF08659 Pfam Desc: KR domain
  misc_feature (2150)..(2269): Pfam Id: PF00106 Pfam Desc: short chain dehydrogenase
MAYFWQPYSSAAFAQVCFRFIFDPFRNAASKHDIALSDFKWRLIMSQPEKNTPESVDDTRLNKRLKDMPVAIVGMASMFANSRYLNKFWDLISEKIDAITEVPDTHWRPEDYYDADRTTPDKSYCKRGGFIPEVDFNPMEFGLPPNILELTDTSQLLSLIVAKEVLEDAKLPEGYDRDKIGITLGVGGGQKIAQSLNARLQYPVLKKVFKSSGISDDDSEMLIKKFQDQYIHWEENSFPGSLGNVISGRIANRFDLGGINCVVDAACAGSLAAMRMALSELVEGRSEMMITGGVCTDNSPTMYMSFSKTPAFTTNETIQPFDIDSKGMMIGEGIGMVALKRLEDAERDGDRIYSVIKGVGSSSDGKFKSIYAPRPEGQAKALKRAYDDAGFAPHTLGLLEAHGTGTAAGDVAEFGGLNSVFSENNEEKQHIALGSVKSQIGHTKSTAGTAGLIKAALALHHKVLPPTINVSAPNPKLDIENSPFYLNTQTRPWMKRVDGTPRRAGISSFGFGGTNFHVVLEEYTPEHARGDKYRQRQVPQTLLFGAESRQALINELKQVSTQAADAAFKLETLAEQHALREVDAKHARIGLVVTDQADLQAQLTQAVSMLESQTKAHWQMPNGTSYRESALIAENGACKVAALFAGQGSQYLNMGRELACHYPEMRQQLAQADQVFGQHKKTALSQILFPIPTFTSEATKAQEAVLTNTANAQSAIGTVSMGQFDIMTQAGFKADMVAGHSFGELSALCASGVISQDDYYQLAFARGDAMAATPEQGDSGTMFAVILDADKLPAVESCISQFEGVSIANYNAPTQLVIAGPTATVQQAAQALTEQGFKAIALPVSGAFHTPLVAHAQKPFAAAIDKASFSAPTLPLYSNATGKLHSKDAKAIKKAFKQHMLQSVRFSEQIEAMYEAGARVFVEFGPKNILQKLVEKTLADKNEELYAISINPSPKGDSDQQLRLAAVQLCVAGVSLDNIDPYQADIAEPAKASPMNIKLNATNYISPATRKKMDQSLASGNVTEKTEIVEVKVEVEKIVEKEVIKTEIVEVPVAAPQASNVQQSVAAPSVQVATATQQPQVAQPAPATIQPTASVTVDESSLQSFFNAQQQAAEVHQQFLAIPQQYGDTFNTLMSEQAKMATAGVAIPENLQRSMEMFHQHQAETLKAHAHYLEMQAHSNNSALNMLTQGSVLTAQPTFVASVNAQPAIQATPTAIVQQPVAQVQATPVQAQSVQAAPVQNTTTQQAPIQKAAPAPQVAAQAAAPAAQPVPVKTQPAPVAAPVAVQSADAEKVMLEVVAKKTGYPTEMLDLEMDMEADLGIDSIKRVEILGTVQDEMPNLPELNPEDLAECRTLGEIVTYMNSKMPASAPVAAQPSATAPVQAANGLDAKVVQQTMLEVVAEKTGYPTEMLDLEMDMEADLGIDSIKRVEILGTVQDELPTLPELNPEDLAECRTLGEIVDYMNSKLPASAPAVAQPAATSVQAVSGLDAAVVQKTMLEVVAEKTGYPTEMLDLAMDMEADLGIDSIKRVEILGTVQDELPTLPELNPEDLAECRTLGEIVDYMNSKLPASAPVAAQISAPAQAVSNGLNAEQVQGTMLSVVADKTGYPTEMLDLAMDMEADLGIDSIKRVEILGTVQDQLPTLPELNPEDLAECRTLGEIVDYMNSKLAPSSEAATVAPAAEVEAIVESASNDLNPAHVQSTMMEVVADKTGYPAEMLDLAMDMEADLGIDSIKRVEILGTVQDQLPTLPELNPEDLAECRTLGEIVTYMQSKLSAAAPVATPKAESVTPIAETATAELPPHNEVALKKLPAADKLVDCFSKDACVVITDDGHNAGVLAEKLTANGIQVAVVRSALSAASPLNSEIASYTLNSVDDAGVTAVINDIEADLETSNKVIAGFIHLQAIVDAKQSNEQAVNLNADSRTSLTTAFLFAKHLNGQLNAVSGRSVFFTLSRIDGGFGYLDTKQLMNAELNQAALSGLTKTLSHEWPNVFCRALDADASIDARHLAEAITGELFDIDTNTVEIGLSHAENGESGRATLIAATPGAAQTKNTGAQLTKNDKVLVTGGAKGVTFECALTLAKQCKSHFILAGRSKHITSAELPQWAQGKQEKELKPAAIAHLQATGDKPTPKKVDTLLKPVLSSLEINAALAAFNEIGASAEYLSLDVSNHESVAKTLANFEGITGLIHGAGVLADKHIQDKTLDELNMVYGTKVGGLEAVLSGLDSSKLKLIAMFSSAAGFYGNTGQSDYSMSNEILNKAALQLSARNPQAKVMSFNWGPWDGGMVNAALKRMFTERGVYVIPLQAGAELFSSQLLNETGIQLLVGTSMQGSDNKEAAVKKLNAESVHLAKSPLNTSITVTRHLDPKALPFIQDHCIAGNPVLPTVCAIQWMREVAEQLLGVNVSVHNYKLLKGVIFDTDEVQELNLVLSSDAKSKDQLKAVISCQGRPQYQAQLQVASVQVSEDVQQASVKRFEANTSAPVTTAQALYSDGTLFHGPRLQGITSVERFDDLGLLAQCQLPQIENSDCGSFIPKQGFGDSQPFAEDYLLQAMLVWARLKYGAASLPSAIGEFICYAPMHNGGQGWLELSVIKSTARSLQADISLYHQDGRLSAVMKGAKVTISKSLNDAFLPKSSSAVSKKEATKNPEKEQLS

SEQ ID NO: 69 - DNA, 2058 bp, Artificial Sequence
  Unknown bacterial isolate SGI-i1607
  misc_feature: PfaB gene
  misc_feature: SGI cDNA ID NO. 1557020
  misc_feature: Encodes the peptide sequence at SEQ ID NO 70
  misc_feature: Useful for modulating production of PUFA
gtgactgttccttctaataaagcgatgccattgcgcatcgctcttttagctcagccagcaaacgcggctgagctttctgccgacttattcccctcgttcccagacatgttaactgttgtggttgatggcgattttaatcaagcacttagccgtgcgattgagactgtaaatcaaggcactgctgttaaactctgtttggattctcactcaccatcattgttgatgttaagtgcgctgaatgctgctcagaataagattcacccacacgcgaatttagcgggctttgccgaaactctcgacctagataatggagatagcgttcagcttgctctagagatgtcacgccgccccgcttcagacttaaaccatcaacagcaatactctgccctatctgcttcgcaacagtttggtcaattgctgaatatggtgaatgcaatatcgagccgttcattaccaaaccattctttaccgggccattattggttcactgagccgaacaaagcacgtgttgctgcgttaactttcagtgacgatagccaaaaagccaccagcctgatattgactcaagcgaccggtttgcaagaaccaaaaccattgctatccagcgagcgtttgatgtttgtggtttcaggcaacgaacaagccgaattggtttctcaattaacctcgttaagagaagatcttaaatgcgttaacgaatcggcagaccgtgaacttgctatcgctaccttaatgcattcaaacctaagtcacttccaaagcgttcagcacaatgctgaccttggcgcgaacatcgtgattcaggcagcttcaattgatgctgcaatacaagagatcacagcggtagaaaatgcgttgccaaaagtaatggctgacaatagccactacaaaacgccagcaggcagttgtttctcaccgatgcctcaaagcaaaggtggtgttgcatttgtttaccctggtgttggcacggtttatcccggtatgttgcgtgaatttcaccaccatttcccacagttatttgctcgtttagaacgtgaaggtaacttgaaagagatgctgcaggctgacaaaacctatactgaagactcgcaagaaatgtcgctcagtgagctggcaattgccggtgtgggaagcagttatctgttaacacaactgctgtgtgatgaattcaaagtgcagccagatttcgctttgggttactccaaaggtgaagcctccatgtgggccagcttaaatgtttggaaaaacccacatgcgctgattgagatgactcaaactagccctattttcaccacggctatttctggcgaactcactgcagtacgtcaagattggcagctgagcagcgacgaaggcatccaatggaatagctttgtggttcgcagtgatgcacaagcgattgaagctctgctaccagagtttccacgtgcttatctcgcaatcatccaaggtgacacttgcgtactggcaggttgtgaaagcacctgtcgtgcactactcaagaaactgggtaaacgtggcattgccgcgaatcgtgttaccgcaatgcacaccacaccagcattgagccaacatagccaagtgcgtgagttttacacgcaaccactgttcgacgaattgccaaagcatatccgctttatcagcgcagcaggtctaccgacgggcgcaccaatcaatatcgacagcgatagcatcgccctttcgattgccgacactttctgttcgacgctggatttcaccgcgttgatccagagtgcacgtcaacaaggtgctcgtctgtttgtcgaagtgggtgccgatcgtcaaaccagcacattgatcgacaagatcaatcgtagcgacaacgtagcagaccaatactgcacaatcgcttccaatgccaaaggcggtgacgatgttgtcacgctcatcaaatgcattggtcagctcattactcatcaaatcccattgtctgtcgagcctcttatccaagggctagaacaacagatcaccgcagctaagcaattaagcggtttatctcaaggcagcgcagtgaattatcaaggagagctagtatga

SEQ ID NO: 70 - protein, 685 aa, Artificial Sequence
  Unknown bacterial isolate SGI-i1607
  misc_feature: PfaB polypeptide
  misc_feature: SGI Peptide ID NO. 1557020
  misc_feature: Useful for modulating production of PUFA
  misc_feature (1)..(685): NCBI GI: 84387724 Blast Desc: omega-3 polyunsaturated fatty acid synthase PfaB [Vibrio splendidus 12B01] gi|84377407|gb|EAP94274.1| omega-3 polyunsaturated fatty acid synthase PfaB [Vibrio splendidus
  misc_feature (1)..(685): NCBI GI: 86147636 Blast Desc: omega-3 polyunsaturated fatty acid synthase PfaB [Vibrio sp. MED222] gi|85834547|gb|EAQ52696.1| omega-3 polyunsaturated fatty acid synthase PfaB [Vibrio sp. MED222]
  misc_feature (1)..(685): NCBI GI: 218710184 Blast Desc: omega-3 polyunsaturated fatty acid synthase PfaB [Vibrio splendidus LGP32] gi|218323203|emb|CAV19380.1| PfaB, omega-3 polyunsaturated fatty acid synthase [Vibrio splendidus
  misc_feature (1)..(685): NCBI GI: 325974044 Blast Desc: omega-3 polyunsaturated fatty acid synthase PfaB [Vibrio sp. NSP560]
  misc_feature (1)..(685): NCBI GI: 90413868 Blast Desc: omega-3 polyunsaturated fatty acid synthase PfaB [Photobacterium profundum 3TCK] gi|90325052|gb|EAS41562.1| omega-3 polyunsaturated fatty acid synthase PfaB [Photobacterium
  misc_feature (1)..(685): NCBI GI: 325974054 Blast Desc: omega-3 polyunsaturated fatty acid synthase PfaB [Photobacterium sp. MA665]
  misc_feature (1)..(685): NCBI GI: 15488032 Blast Desc: AF409100_8 omega-3 polyunsaturated fatty acid synthase PfaB [Photobacterium profundum SS9]
  misc_feature (9)..(685): NCBI GI: 325974034 Blast Desc: omega-3 polyunsaturated fatty acid synthase PfaB [Shewanella sp. MAR441]
  misc_feature (9)..(685): NCBI GI: 54308652 Blast Desc: omega-3 polyunsaturated fatty acid synthase PfaB [Photobacterium profundum SS9] gi|46913081|emb|CAG19870.1| omega-3 polyunsaturated fatty acid synthase PfaB [Photobacterium
  misc_feature (9)..(684): NCBI GI: 212636305 Blast Desc: Omega-3 polyunsaturated fatty acid synthase PfaB [Shewanella piezotolerans WP3] gi|212557789|gb|ACJ30243.1| Omega-3 polyunsaturated fatty acid synthase PfaB [Shewanella WP3]
  misc_feature (159)..(658): Pfam Id: PF00698 Pfam Desc: Acyl transferase domain
MTVPSNKAMPLRIALLAQPANAAELSADLFPSFPDMLTVVVDGDFNQALSRAIETVNQGTAVKLCLDSHSPSLLMLSALNAAQNKIHPHANLAGFAETLDLDNGDSVQLALEMSRRPASDLNHQQQYSALSASQQFGQLLNMVNAISSRSLPNHSLPGHYWFTEPNKARVAALTFSDDSQKATSLILTQATGLQEPKPLLSSERLMFVVSGNEQAELVSQLTSLREDLKCVNESADRELAIATLMHSNLSHFQSVQHNADLGANIVIQAASIDAAIQEITAVENALPKVMADNSHYKTPAGSCFSPMPQSKGGVAFVYPGVGTVYPGMLREFHHHFPQLFARLEREGNLKEMLQADKTYTEDSQEMSLSELAIAGVGSSYLLTQLLCDEFKVQPDFALGYSKGEASMWASLNVWKNPHALIEMTQTSPIFTTAISGELTAVRQDWQLSSDEGIQWNSFVVRSDAQAIEALLPEFPRAYLAIIQGDTCVLAGCESTCRALLKKLGKRGIAANRVTAMHTTPALSQHSQVREFYTQPLFDELPKHIRFISAAGLPTGAPINIDSDSIALSIADTFCSTLDFTALIQSARQQGARLFVEVGADRQTSTLIDKINRSDNVADQYCTIASNAKGGDDVVTLIKCIGQLITHQIPLSVEPLIQGLEQQITAAKQLSGLSQGSAVNYQGELV

SEQ ID NO: 71 - DNA, 6036 bp, Artificial Sequence
  Unknown bacterial isolate SGI-i1607
  misc_feature: PfaC gene
  misc_feature: SGI cDNA ID NO. 1557021
  misc_feature: Encodes the peptide sequence at SEQ ID NO 72
  misc_feature: Useful for modulating production of PUFA
atgagttctcaatcgaaaccatctcaatataaatatcaggctcaaaacaagcagcaagtgaagtgcaataagatcgcgattgtcggtattgctaaccaatacccagaagctgatacgccaaaagacttttggcaaaacttgctgaataaaaaagattctcgaaccacattaagctctgaaaagttaggtgctaaacctgaaagctatcagggcgttcaaggtgagtcagaccgcttttactgtgacaaaggcggctacatcgaaaacttcaatttcgatagcaatggctaccgcttaacagcagaatcatttaacggcgtagatcaaagcttcctatgggctttggacacaagtcgtaaggcgttagtcgacgcaggcattaatttaaatgccgatgttttagagcgcacaggcgtgatcatgggtgccctttcgttcccaaccacacgttcaaacgacctgtttctgccgatgtatcactcggtggtcgagaaagcacttaaagataaattggctaatgaccagttttcactgctaccaaccaatgaaaccgcgcaagacctcaaccctatcaatggtgctgcagcacataatgcctctaagttagtggctgatgcattgggtctaggcaacgtgcaacttagcctagatgcagcatgtgcaagttcagtgtattcattgaagttagcgtgtgattacttgaacacgggcaaagccgacatgatgttggcaggcgcggtatcaggtgctgacccattctttatcaacatgggtttttccattttccacgcttaccctgaccacggtgtgtcggttccgtttgatagcaacagtaaaggtctatttgctggcgaaggtgccggtgttttagtcctaaaacgcttagctgatgcagagcgtgatggcgacaacatttacgcagtcgtcagcggtattggcttgtcgaacgatggccgtggccagttcgtattaagcccaaatagcaaaggacaagtacaagcctttgaacgcgcttacgaggcttcgaacttatcaccagacagcattgaagtgattgaatgtcacgcaaccggcacaccattaggtgacaaggttgagttaacctcaatggagcgtttctttgctgacaaattgaatggttctaacccgccattgattggctctgcgaagtcaaacctcggtcacttactgactgcggcaggtatgccagggatcatgaagatgatctttgcgatgaaagaaggcgtgcttcctccaagtattaatttggacaagccactatcgtcaccagaaggtttatttggctcacaaactctgccaacgcaggttcaaccttggccaagtaaagcaggtaaccaagagcgctgtgcgggtgtttctgtatttggtttcggtggttgtaacgctcacttactgcttgaagcgtattcagataagagtcatataaaccagactctagagtcagcgtatccaagcctacagccgtctaatttaagcattactggcctcgcgtctcacttcggttctctgcaaagtatcaacgcgctaagcactgccattgaaaccaacaacgatgctttcattgctttgcctaagaaacgctggaaaggcttagaccaacatccagaactactgaatcagtttggtttacacggcattccaaatggagcgtacatcgatcaattcgatctcgatttcctgcgcttcaaagtgccgcctaatgaagatgaccgtttgatctctcagcagttgctactaatgaaagttgcagacgaagccatcaaagatgccaagcttgttgcaggccaaaaggttgcggttttagttgcgatggaaacagagcttgaaatgcaccaattccgtggacgcgtaaacctgcatagccaactggctgacagctttgccaacatgggtattgagctaacacaagacgaataccaatcgctagaaaccatcgcgatggacagtgtgatggacgcagccaagctgaaccaatacaccagtttcatcggcaatatcatggcttcgcgtatctcttcactatgggactttaacggccctgcgtttacgatttcagccgctgaacagtcagttgctcgttgtatcgatgtcgcgcaaaacctaatgtcgcaagaatcaatggacgcagtcgtgattgcagccgttgaccttagtggcagtgcagagcatgtgattctgaagaacagcatgagcccagtgtcgcttgctccaaaattcggacaaccgcaagacggcagttggaatgtaggcgaaggcgcaggtgcaattgttcttgtggaagaaggtcgagtagctagcaatcaagatacggcttacggcagcatcaacgcattagcctttggttcaagcgagcgtaacaacgccgttgctgatgagttactgactcaagtcggtatgaactcgaacgatatttcattgcttgagcttaaccatgcaccagagtcttcatcacacgagcttgtacctctcaacttaggggttaccaagacgactcaagcgagtcaacgtgttggtcattgctctgctgcttctggcatggcaagcctgctacacggtctgctcaacctgaaccttgagtctctgaatcaaaatgtcagatctaagagcgcgattgttgccaacatcagcgaagggcaatgttcacagctgctactaagccaatcgagtgttgaatctcaatcactttccgttcgtttaagcaatgaactggcgagtgatgcgaaacgtcaattggttaagcaagtgactcttggtggtcgcgatatctatcaacatattgcccaaaccccagtgactaacttagcaacgattcaacagaaagcttctggtaaacaagctgcaagagtggcgtcggttccaacgacagcaagcattcaagcagcccttgcacaaaaagagttagagaagaatgcattagcgcagaacgcggtagagcaagtaatcgaaactcctacatcagtatcccctactctggcgccaactcgccacagtcagctaacaggtaaccacagcaatatgactcatgtcctatccgctaaaaatggcgtatcgaatatcgacgctaatacggatgcagcatcacagccgtctgtaacaccacacaaccaagcttttgctcaaaaccagcaagcagcgcagcaggtacacaaagcattcttgcacactcgtgcccaaggcatgcaaatggctgatgcactattaaaagcgcagctaaacgcagtgacatctggtttagatagctcagccgtttctcaacaaaaaaatggtcaacaaacgaatggtcaacaagcgactggccaacaaacatcagctcagcctgttcaagctcaaccggctcaggttcagtcaatgccagtcaacgtacttgcgacgcctgcaccagtaaaacctatccgtaagccatgtatctgggattatgatgatctggttgaatacgctgaaggcgatatcgccaacgtatttggtcctgattacgcgatcatcgatagctactcgcgccgcgttcgcttaccaaccaccgactacctattggtatctcgtgtaaccaagctcaacgcgacagtgaacgagtacaagccaagcacaatgaccacagaatacgacatccctgttgatgcgccgtatcttgttgatggtcagatcccttgggctgtagcggtagaatctggtcagtgtgacctaatgctgatcagctacctaggtatcgattttgaaaacaaaggcgagcgtgtttaccgcttgttagattgtacgctgaccttccttggcgacttgcctcgtggtggcgatacactgcgttacgatatctcaatcaacaactttgctcgcaatggcgacacgctgctgttcttcttctcgtacgaatgtttcgttggcgacaagatgatcctgaaaatggataacggctgtgcgggcttcttcactgatgaagagctagcaggtggcaaaggtgtgattcacactgaagatgaaatcaaggcgcgtaagcttgcaactaagcaacgcttcaaccctatgttgcactgtcctaaaacccagtttaaccaccaagaactgcgtcatctactgactgccaacattgcagaatgttttggcccaactcaccaatccaatagccaccagccttctctatgcttcagctcagagaagttcatgatgatcgaaaaggttagccgtgttgaaccgcaaggcggcacatggggacttggtctgattgaaggtcataagcagctagagcctgagcactggtacttcccttgtcacttcaaagatgactcagtaatggctggctctttgatggcagaaggttgtggtcaactgcttcaattcttcatgatgcatcttggcatgcacacgcttgttcaaaatggtcgtttccaaccgcttgaaaatgcccctcaacaagtgcgttgtcgtggtcaagttctaccacaatcggcagaactgacttaccgcatggaagtaactgagattggtctaagccctcgcccatacgcgaaagctaacatcgatattttgctgaacggcaaagtgattgttgatttccaaaacttgggtgtgatgatcaaagaagacgacgaatgtactcgttacttgccttctttagagacagctaagatcttagttgctgacaccgtagcagagacaacggtcgcgactcctgtgattgaaaacttgggtcatacaccagcggttaaccaacaggcttcagctaatgcgccgttgatggcacaaattgaagacctagcaacagcgccaaacaaaggtgtcgttccacttcaacacgttgaagcgccggtaacacctgattacccgaaccgcacgccagacacagttccgtttacgccttatcacatgttcgagttcgcaactggcgatatcgagaaatgtttcggtcctgatttctctatttaccgtggcatgatcccaccacgtactccgtgtggcgacttgcagctaacgacacgtgtggttgagattgaaggtaaacgtggtgaattcaagaaaccatcttcatgtatcgcagaatacgaagtgccagaaaacgcatggtactttgatgaaaacagccaccaaaccttgatgccttactcggtattaatggagatttcactgcagccaaacggctttatctctggatacatgggcacaacactgggcttcccgggtgaagagttatttttccgtaacctagacggcagcggcaaaatgctacgcaatgtcgatttacgtggcaaaaccatcaccaacgattctcgtctgctttcaacggtaatgatgggtaccaacatcgtacagagcttcagctttgagctaagcactgacggtgtgcctttctaccaaggtacagcggtatttggttacttcaaaggcgcagcactgaaagaccaacttggtttggacaacggtaaagtgactcacgcatggcacgttgataacaatcgcacgccagacgtaaacatcaacttgctagacaaaacgagtcgttactttaatgcacctgtttctgctactggtgaagtgcaagagcactaccaactggctggcggtcgtttgaacttcatcgatacagtgcagatcactagcgatggtggtaaagacggtctgggttacctatacgctgagcgtacgattgacccaagtgattggttcttccagttccacttccatcaagacccggtaatgccaggctctctaggtgtcgaagcgatcatcgagttaatgcaaacctatgcactaaacaaagatcttggtgctggcttccgcaatccgaaatttggtcaaatccaatctgaagtgaaatggaaataccgtggtcagattaaccctctgaacaaacagatgtcactggatgtacacatcactgcgattaaagacgaagacggcaaacgcatcatcgttggcgacgcaaacctgagcaaagatggtctgcgtatttacgaagtgaaagacatcgcgatttgtatcgaagaagctcctgttatcgataaagcctctgttatcaataaagcttaa

SEQ ID NO: 72 - protein, 2011 aa, Artificial Sequence
  Unknown bacterial isolate SGI-i1607
  misc_feature: PfaC polypeptide
  misc_feature: SGI Peptide ID NO. 1557021
  misc_feature: Useful for modulating production of PUFA
  misc_feature (1)..(1999): NCBI GI: 84387723 Blast Desc: omega-3 polyunsaturated fatty acid synthase PfaC [Vibrio splendidus 12B01] gi|84377406|gb|EAP94273.1| omega-3 polyunsaturated fatty acid synthase PfaC [Vibrio splendidus
  misc_feature (1)..(1999): NCBI GI: 86147637 Blast Desc: omega-3 polyunsaturated fatty acid synthase PfaC [Vibrio sp. MED222] gi|85834548|gb|EAQ52697.1| omega-3 polyunsaturated fatty acid synthase PfaC [Vibrio sp. MED222]
  misc_feature (1)..(1999): NCBI GI: 218710185 Blast Desc: omega-3 polyunsaturated fatty acid synthase PfaC [Vibrio splendidus LGP32] gi|218323204|emb|CAV19381.1| PfaC, omega-3 polyunsaturated fatty acid synthase [Vibrio splendidus
  misc_feature (14)..(1999): NCBI GI: 90413867 Blast Desc: omega-3 polyunsaturated fatty acid synthase PfaC [Photobacterium profundum 3TCK] gi|90325051|gb|EAS41561.1| omega-3 polyunsaturated fatty acid synthase PfaC [Photobacterium
  misc_feature (14)..(1999): NCBI GI: 15488033 Blast Desc: AF409100_9 omega-3 polyunsaturated fatty acid synthase PfaC [Photobacterium profundum SS9] gi|325974056|emb|CCA30308.1| omega-3 polyunsaturated fatty acid synthase PfaC [Photobacterium
  misc_feature (14)..(1999): NCBI GI: 325974036 Blast Desc: omega-3 polyunsaturated fatty acid synthase PfaC [Shewanella sp. MAR441]
  misc_feature (14)..(1999): NCBI GI: 54308651 Blast Desc: omega-3 polyunsaturated fatty acid synthase PfaC [Photobacterium profundum SS9] gi|46913080|emb|CAG19869.1| omega-3 polyunsaturated fatty acid synthase PfaC [Photobacterium
  misc_feature (14)..(1999): NCBI GI: 157376336 Blast Desc: omega-3 polyunsaturated fatty acid synthase PfaC [Shewanella sediminis HAW-EB3] gi|157318710|gb|ABV37808.1| omega-3 polyunsaturated fatty acid synthase PfaC [Shewanella
  misc_feature (14)..(1999): NCBI GI: 170725782 Blast Desc: beta-hydroxyacyl-(acyl-carrier-protein) dehydratase FabA/FabZ [Shewanella woodyi ATCC 51908] gi|169811129|gb|ACA85713.1| dehydratase FabA/FabZ [Shewanella
  misc_feature (21)..(1999): NCBI GI: 212557791 Blast Desc: Multi-domain beta-ketoacyl synthase [Shewanella piezotolerans WP3]
  misc_feature (23)..(298): Pfam Id: PF00109 Pfam Desc: Beta-ketoacyl synthase, N-terminal domain
  misc_feature (306)..(424): Pfam Id: PF02801 Pfam Desc: Beta-ketoacyl synthase, C-terminal domain
  misc_feature (499)..(768): Pfam Id: PF00109 Pfam Desc: Beta-ketoacyl synthase, N-terminal domain
  misc_feature (1389)..(1522): Pfam Id: PF07977 Pfam Desc: FabA-like domain
  misc_feature (1858)..(1990): Pfam Id: PF07977 Pfam Desc: FabA-like domain
MSSQSKPSQYKYQAQNKQQVKCNKIAIVGIANQYPEADTPKDFWQNLLNKKDSRTTLSSEKLGAKPESYQGVQGESDRFYCDKGGYIENFNFDSNGYRLTAESFNGVDQSFLWALDTSRKALVDAGINLNADVLERTGVIMGALSFPTTRSNDLFLPMYHSVVEKALKDKLANDQFSLLPTNETAQDLNPINGAAAHNASKLVADALGLGNVQLSLDAACASSVYSLKLACDYLNTGKADMMLAGAVSGADPFFINMGFSIFHAYPDHGVSVPFDSNSKGLFAGEGAGVLVLKRLADAERDGDNIYAVVSGIGLSNDGRGQFVLSPNSKGQVQAFERAYEASNLSPDSIEVIECHATGTPLGDKVELTSMERFFADKLNGSNPPLIGSAKSNLGHLLTAAGMPGIMKMIFAMKEGVLPPSINLDKPLSSPEGLFGSQTLPTQVQPWPSKAGNQERCAGVSVFGFGGCNAHLLLEAYSDKSHINQTLESAYPSLQPSNLSITGLASHFGSLQSINALSTAIETNNDAFIALPKKRWKGLDQHPELLNQFGLHGIPNGAYIDQFDLDFLRFKVPPNEDDRLISQQLLLMKVADEAIKDAKLVAGQKVAVLVAMETELEMHQFRGRVNLHSQLADSFANMGIELTQDEYQSLETIAMDSVMDAAKLNQYTSFIGNIMASRISSLWDFNGPAFTISAAEQSVARCIDVAQNLMSQESMDAVVIAAVDLSGSAEHVILKNSMSPVSLAPKFGQPQDGSWNVGEGAGAIVLVEEGRVASNQDTAYGSINALAFGSSERNNAVADELLTQVGMNSNDISLLELNHAPESSSHELVPLNLGVTKTTQASQRVGHCSAASGMASLLHGLLNLNLESLNQNVRSKSAIVANISEGQCSQLLLSQSSVESQSLSVRLSNELASDAKRQLVKQVTLGGRDIYQHIAQTPVTNLATIQQKASGKQAARVASVPTTASIQAALAQKELEKNALAQNAVEQVIETPTSVSPTLAPTRHSQLTGNHSNMTHVLSAKNGVSNIDANTDAASQPSVTPHNQAFAQNQQAAQQVHKAFLHTRAQGMQMADALLKAQLNAVTSGLDSSAVSQQKNGQQTNGQQATGQQTSAQPVQAQPAQVQSMPVNVLATPAPVKPIRKPCIWDYDDLVEYAEGDIANVFGPDYAIIDSYSRRVRLPTTDYLLVSRVTKLNATVNEYKPSTMTTEYDIPVDAPYLVDGQIPWAVAVESGQCDLMLISYLGIDFENKGERVYRLLDCTLTFLGDLPRGGDTLRYDISINNFARNGDTLLFFFSYECFVGDKMILKMDNGCAGFFTDEELAGGKGVIHTEDEIKARKLATKQRFNPMLHCPKTQFNHQELRHLLTANIAECFGPTHQSNSHQPSLCFSSEKFMMIEKVSRVEPQGGTWGLGLIEGHKQLEPEHWYFPCHFKDDSVMAGSLMAEGCGQLLQFFMMHLGMHTLVQNGRFQPLENAPQQVRCRGQVLPQSAELTYRMEVTEIGLSPRPYAKANIDILLNGKVIVDFQNLGVMIKEDDECTRYLPSLETAKILVADTVAETTVATPVIENLGHTPAVNQQASANAPLMAQIEDLATAPNKGVVPLQHVEAPVTPDYPNRTPDTVPFTPYHMFEFATGDIEKCFGPDFSIYRGMIPPRTPCGDLQLTTRVVEIEGKRGEFKKPSSCIAEYEVPENAWYFDENSHQTLMPYSVLMEISLQPNGFISGYMGTTLGFPGEELFFRNLDGSGKMLRNVDLRGKTITNDSRLLSTVMMGTNIVQSFSFELSTDGVPFYQGTAVFGYFKGAALKDQLGLDNGKVTHAWHVDNNRTPDVNINLLDKTSRYFNAPVSATGEVQEHYQLAGGRLNFIDTVQITSDGGKDGLGYLYAERTIDPSDWFFQFHFHQDPVMPGSLGVEAIIELMQTYALNKDLGAGFRNPKFGQIQSEVKWKYRGQINPLNKQMSLDVHITAIKDEDGKRIIVGDANLSKDGLRIYEVKDIAICIEEAPVIDKASVINKA

SEQ ID NO: 73 - DNA, 1638 bp, Artificial Sequence
  Unknown bacterial isolate SGI-i1607
  misc_feature: PfaD gene
  misc_feature: SGI cDNA ID NO. 1557023
  misc_feature: Encodes the peptide sequence at SEQ ID NO 74
  misc_feature: Useful for modulating production of PUFA
atgacaactcaaactacaatcaataacgaaaagctatctccgtggccttggcagattgaagggagcactactcatttcgataacgcagcaatgtcgacaatcttgaaagatttaagccttgcttgttacgtagtgaaccacccagaaaaaggcttaggcgtaagccaacaagctgagattacatcgggcgattcagctagcgcagcaaacagtcagcctgttagcgcttttgctccagctcttggtacacaaagcctaggcgacgaagattttcgtcgctgccacggcgtaaaatacgcttactatgcaggtgcaatggcaaacggcatttcatctgaagagttagtgattgcgcttggtcaagctggcattctttgttcatttggcgcggcgggcttaatcccgtctcgcgttgagcaagcgatcaaccgtattcaagcagcactaccaaacggtccttacgcgtttaacctgattcacagcccaagtgaacctgcactagagcgcggcagtgtagagctgtttttgaagcaccaagtaaaaacggttgaggcttcagcattcttaggtttaacaccgcaaatcgttcactaccgtgcagcaggccttagtcgcgatgcacaaggtgagattcagattggcaacaaggttattgccaaggtaagccgtactgaagtagcgagcaagttcatgcaacctgctcctgtaaaaatgctgcaagctttggttgatgaaggtcgaatcacagcagaacaaatggaactggcacagttggttcctatggctgatgacattactgcagaagccgattctggtggtcacaccgataatcgtccgctagtaaccctactgccaacgattcttgcactgaaagagcaaatccaagctcagtatcaattcaaaacaccgctgcgtgttggctgtggtggtggcgtaggcacgcctgacgctgctctagcaacgtttaacatgggcgcggcttacattgttactggttcaatcaaccaagcgtgtgttgaggctggcgcgagcgaacacacacgtaagctgctttcgacaactgaaatggctgacgtgactatggccccggcggcagacatgttcgaaatgggtgtgaaactgcaagtggttaaacgcggcaccttgttcccaatgcgtgcaaacaagctatacgagctatacacgcgctacgattcaattgaagcgattccagcagaagaacgcctgaagttagagaagcaagtattccgttcaacactggatgacatttgggcgggaactgtggcgcactttaacgagcgcgaccctaaacagatcgaacgtgctgaaggcaatcctaaacgtaaaatggcgttaatcttccgttggtacttagggctttctagccgttggtcaaacacaggtgaacaaggtcgtgaaatggattaccaagtatgggcaggccctgcacttggcgcattcaacgcatgggcaaaagacagctatctagacgattaccaacagcgtaatgccgttgatctagcaaaacacctaatgcatggcgcagcctacttggctcgcattaacttgctgacctcacaaggcatcaagcttgatcctgaactcgcacgctggaagccaactcaaagaatggcttaa

SEQ ID NO: 74 - protein, 545 aa, Artificial Sequence
  Unknown bacterial isolate SGI-i1607
  misc_feature: PfaD polypeptide
  misc_feature: SGI Peptide ID NO. 1557023
  misc_feature: Useful for modulating production of PUFA
  misc_feature (1)..(545): NCBI GI: 86147638 Blast Desc: omega-3 polyunsaturated fatty acid synthase PfaD [Vibrio sp. MED222] gi|85834549|gb|EAQ52698.1| omega-3 polyunsaturated fatty acid synthase PfaD [Vibrio sp. MED222]
  misc_feature (1)..(545): NCBI GI: 218710186 Blast Desc: omega-3 polyunsaturated fatty acid synthase PfaD [Vibrio splendidus LGP32] gi|218323205|emb|CAV19382.1| PfaD, omega-3 polyunsaturated fatty acid synthase [Vibrio splendidus
  misc_feature (1)..(545): NCBI GI: 84387722 Blast Desc: omega-3 polyunsaturated fatty acid synthase PfaD [Vibrio splendidus 12B01] gi|84377405|gb|EAP94272.1| omega-3 polyunsaturated fatty acid synthase PfaD [Vibrio splendidus
  misc_feature (1)..(545): NCBI GI: 325974048 Blast Desc: omega-3 polyunsaturated fatty acid synthase PfaD [Vibrio sp. NSP560] gi|325974058|emb|CCA30309.1| omega-3 polyunsaturated fatty acid synthase PfaD [Photobacterium sp.
  misc_feature (1)..(544): NCBI GI: 325974038 Blast Desc: omega-3 polyunsaturated fatty acid synthase PfaD [Shewanella sp. MAR441]
  misc_feature (1)..(544): NCBI GI: 90413866 Blast Desc: omega-3 polyunsaturated fatty acid synthase PfaD [Photobacterium profundum 3TCK] gi|90325050|gb|EAS41560.1| omega-3 polyunsaturated fatty acid synthase PfaD [Photobacterium
  misc_feature (1)..(544): NCBI GI: 54308650 Blast Desc: omega-3 polyunsaturated fatty acid synthase PfaD [Photobacterium profundum SS9] gi|15488034|gb|AAL01063.1|AF409100_10 omega-3 polyunsaturated
  misc_feature (1)..(544): NCBI GI: 219806610 Blast Desc: omega-3 polyunsaturated fatty acid synthase PfaD [Shewanella livingstonensis]
  misc_feature (1)..(544): NCBI GI: 114562396 Blast Desc: 2-nitropropane dioxygenase [Shewanella frigidimarina NCIMB 400] gi|114333689|gb|ABI71071.1| 2-nitropropane dioxygenase, NPD [Shewanella frigidimarina NCIMB 400]
  misc_feature (6)..(545): NCBI GI: 212557792 Blast Desc: Polyunsaturated fatty acid synthase PfaD [Shewanella piezotolerans WP3]
  misc_feature (93)..(366): Pfam Id: PF03060 Pfam Desc: Nitronate monooxygenase
MTTQTTINNEKLSPWPWQIEGSTTHFDNAAMSTILKDLSLACYVVNHPEKGLGVSQQAEITSGDSASAANSQPVSAFAPALGTQSLGDEDFRRCHGVKYAYYAGAMANGISSEELVIALGQAGILCSFGAAGLIPSRVEQAINRIQAALPNGPYAFNLIHSPSEPALERGSVELFLKHQVKTVEASAFLGLTPQIVHYRAAGLSRDAQGEIQIGNKVIAKVSRTEVASKFMQPAPVKMLQALVDEGRITAEQMELAQLVPMADDITAEADSGGHTDNRPLVTLLPTILALKEQIQAQYQFKTPLRVGCGGGVGTPDAALATFNMGAAYIVTGSINQACVEAGASEHTRKLLSTTEMADVTMAPAADMFEMGVKLQVVKRGTLFPMRANKLYELYTRYDSIEAIPAEERLKLEKQVFRSTLDDIWAGTVAHFNERDPKQIERAEGNPKRKMALIFRWYLGLSSRWSNTGEQGREMDYQVWAGPALGAFNAWAKDSYLDDYQQRNAVDLAKHLMHGAAYLARINLLTSQGIKLDPELARWKPTQRMA

SEQ ID NO: 75 - DNA, 849 bp, Artificial Sequence
  Unknown bacterial isolate SGI-i1607
  misc_feature: PfaE gene
  misc_feature: SGI cDNA ID NO. 1557048
  misc_feature: Encodes the peptide sequence at SEQ ID NO 76
  misc_feature: Useful for modulating production of PUFA
atgagtgctagagatatgggaataccgattgtgggtttgtggctttgctctctgagtgatttacatgatgatatcgatagcgtgtcgtacttaaaacagagactcacgatggatgagatagccaaagttgatcgctatcgaatgccctcatctcaggttcaagctttgtacgttcgtaactatctaagaaaggtgttgtcttgctattctgatttgaggccagaagagtggcggtttgaatatggcgagaaaggtaagccaagcctaattacagaacaacaaattaaaacgggattgaatttcaatataagccatagccaagaccatttgttgatcgctatttgccaaatccaagggcaaccacttcaactaggtgtagatatcgaacatgcaagaagctcgaccaatatcgactcgatcatgaagcactatttttcagatgcagaacttacggatttacttgaactcaacaaagaagaacagagagagcgttttttcgatctgtgggcattgaaagagtcgtacatcaaagcgacgggtaaggggctagcgacatcgttgcgaagcttttcgtttgatttctctaatttgacggagcaaacattgccaattcactcttcggattttcaaccaaacttgcaggatgaaattagattgtatagcgaaatcaggctacatagcgggattgggttggatttggattctgctcaagaagacgatatttctacagattggcaatgttgcttgggtcgattagatgaccagtaccgttttgccgtgacccttggtggaaatttgctacccatgcagatagagatgagaactttttcgttgtctcatctcttttaa

SEQ ID NO: 76 - protein, 282 aa, Artificial Sequence
  Unknown bacterial isolate SGI-i1607
  misc_feature: PfaE gene
  misc_feature: SGI Peptide ID NO. 1557048
  misc_feature: Useful for modulating production of PUFA
  misc_feature (6)..(282): NCBI GI: 86147634 Blast Desc: 4'-phosphopantetheinyl transferase family protein [Vibrio sp. MED222] gi|85834545|gb|EAQ52694.1| 4'-phosphopantetheinyl transferase family protein [Vibrio sp.
  misc_feature (6)..(282): NCBI GI: 325974050 Blast Desc: omega-3 polyunsaturated fatty acid synthase PfaE [Vibrio sp. NSP560]
  misc_feature (6)..(282): NCBI GI: 84387726 Blast Desc: 4'-phosphopantetheinyl transferase family protein [Vibrio splendidus 12B01] gi|84377409|gb|EAP94276.1| 4'-phosphopantetheinyl transferase family protein [Vibrio 12B01]
  misc_feature (6)..(282): NCBI GI: 218710182 Blast Desc: 4'-phosphopantetheinyl transferase [Vibrio splendidus LGP32] gi|218323201|emb|CAV19378.1| 4'-phosphopantetheinyl transferase [Vibrio splendidus LGP32]
  misc_feature (9)..(264): NCBI GI: 212636300 Blast Desc: 4'-phosphopantetheinyl transferase [Shewanella piezotolerans WP3] gi|212557784|gb|ACJ30238.1| 4'-phosphopantetheinyl transferase [Shewanella piezotolerans WP3]
  misc_feature (9)..(261): NCBI GI: 170727642 Blast Desc: 4'-phosphopantetheinyl transferase [Shewanella woodyi ATCC 51908] gi|169812989|gb|ACA87573.1| 4'-phosphopantetheinyl transferase [Shewanella woodyi ATCC 51908]
  misc_feature (11)..(263): NCBI GI: 157962724 Blast Desc: 4'-phosphopantetheinyl transferase [Shewanella pealeana ATCC 700345] gi|157847724|gb|ABV88223.1| 4'-phosphopantetheinyl transferase [Shewanella pealeana ATCC
  misc_feature (11)..(263): NCBI GI: 167624919 Blast Desc: 4'-phosphopantetheinyl transferase [Shewanella halifaxensis HAW-EB4] gi|167354941|gb|ABZ77554.1| 4'-phosphopantetheinyl transferase [Shewanella halifaxensis
  misc_feature (11)..(282): NCBI GI: 206570562 Blast Desc: 4'-phosphopantetheinyl transferase [Shewanella sp. BR-2]
  misc_feature (35)..(263): NCBI GI: 149675712 Blast Desc: 4'-phosphopantetheinyl transferase [Shewanella livingstonensis]
  misc_feature (124)..(187): Pfam Id: PF01648 Pfam Desc: 4'-phosphopantetheinyl transferase superfamily
MSARDMGIPIVGLWLCSLSDLHDDIDSVSYLKQRLTMDEIAKVDRYRMPSSQVQALYVRNYLRKVLSCYSDLRPEEWRFEYGEKGKPSLITEQQIKTGLNFNISHSQDHLLIAICQIQGQPLQLGVDIEHARSSTNIDSIMKHYFSDAELTDLLELNKEEQRERFFDLWALKESYIKATGKGLATSLRSFSFDFSNLTEQTLPIHSSDFQPNLQDEIRLYSEIRLHSGIGLDLDSAQEDDISTDWQCCLGRLDDQYRFAVTLGGNLLPMQIEMRTFSLSHLF

SEQ ID NO: 77 - DNA, 7821 bp, Vibrio sp.
  misc_feature: PfaA gene
  misc_feature: SGI cDNA ID NO. 1551532
  misc_feature: Encodes the peptide sequence at SEQ ID NO 78
  misc_feature: Useful for modulating production of PUFA
atgagccaacccgagacaaatacaccggaatcagtcgacgatactcgactgaataaacgccttaaagatatgcctgtcgctatcgttggtatggcgagcatgtttgcaaactctcgctacctgaataaattttgggaccttatcagcgaaaaaatcgatgcgattactgaagtaccagatacgcactggcgtccagaagattactacgactcagatcgtactacgccagacaagtcttactgtaagcgcggtggtttcatcccagaagtggacttcaaccctatggagttcggtcttccgccaaatatcctagaactgactgatacgtcgcagctgctttctctgatcgttgcaaaagaagtacttgaagatgccaagctgcctgaaggctacgatcgcgataagatcggtatcacgctcggtgttggtggtggtcagaagatcgctcaaagcctaaatgctcgcctgcaataccctgttttgaaaaaagtcttcaagagcagtggcatcaacgacgaagacagcgaaatgctgatcaaaaagttccaagaccaatacatccactgggaagagaactcattccctggttcattaggtaacgtaatttcaggtcgtattgctaaccgctttgaccttggtggcatcaactgtgtggtagatgctgcgtgtgcaggttctctagccgcaatgcgcatggcactgagcgagctggttgaaggccgcagcgaaatgatgatcacaggtggtgtgtgtactgataactcgccaaccatgtacatgagtttctctaaaacacctgcatttaccaccaatgaaaccattcaacctttcgacatcgactcaaaaggcatgatgattggtgaaggcatcggtatggttgctctgaagcgcttagaagatgcagaacgcgatggcgacagaatctactcagtgattaaaggtgtcggttcttcttcggatggtaaattcaagagtatttacgcacctcgccctgaaggacaagcaaaagcactgaaacgtgcttacgacgatgctggtttcgcaccgcacacgcttggcctattagaagcgcacggtacaggtacagcagcgggtgatgttgctgaatttggaggcttaaactcggtattcagtgagaacaatgaagagaagcaacacattgcgttaggctctgtgaaatctcaaattggtcacaccaaatcaaccgcgggtactgcaggtttaatcaaagctgcattagcactgcaccacaaagtactgccgccaacgatcaacgtatcggctccgaatcctaaactggatatcgagaactctccgttctacctaaacacacaaacgcgtccttggatgaaacgtgtcgacggcacaccacgccgtgcaggtatcagctcattcggttttggtggcactaacttccacgttgtattggaagagtacacaccagagcacgctcgcggtgacaaataccgtcagcgccaagtgccgcaaacgctgttattcagcgcagaatctcgtcaagcactgatcaatgagctcaagcaggtttcaactcaagctgcagacgctgcgttcaaactggaagcgcttgctgaacaacacgctctacgcgaagttgatgctaagcatgctcgtattggtttagttgtcactgaccaagcagaccttcaagcgcaactgactcaagcggtttctatgcttgagagccaaaccaaaacacattggcagatgccaaacggtactagctaccgtgaatcagcactgattgctgaaaacggtgctggtaaagtggctgcattatttgcaggtcaaggttcgcaatacctaaacatgggtcgcgagcttgcttgtcattaccctgagatgcgtcaacagcttgctcaagcggatcaggtatttggtcaacacaagaaaacggctctgtcgcaaattctgttcccaattccaaccttcacaccagaagcaaccaaagctcaagaagcggtgctaaccaacacggccaatgcgcaaagtgcgattggtactgtgtctatgggtcagttcgacatcatgactcaagctggcttcaaagccgacatggtcgcaggccacagctttggtgagctaagcgcactatgtgcatcgggtgttatctcgcaagacgattactaccagctagctttcgctcgtggcgatgcgatggcggcgacaccagaacaaggcgacagcggtactatgtttgcggtcatcctagacgcagacaagcttccagccgttgaaagctgcatcagccaattcgaaggtgtgagcattgccaactacaacgctccgactcaattggttattgcaggtccaacagcaaccgttcaacaagcagcacaggcgctaacagaacaaggcttcaaagcgattgctctgccagtatctggtgctttccacacaccacttgttgctcacgctcaaaagccatttgctgcggcaattgataaagcttcattcagcgctccaacgctgccgctttactcaaacgcaacaggcaagctgcacagcaaagacgcgaaagcgattaagaaagcattcaaacagcacatgctgcaatcggttcgtttcagcgaacaaattgaagcgatgtacgaagcaggcgcgcgcgtattcgttgagttcggtccgaaaaacattcttcaaaagctggttgaaaaaacattggctgataagaacgaagagctttacgcaatcagcatcaacccaagccctaaaggcgacagtgaccaacagcttcgtttagctgcggttcaactgtgtgtggcaggtgtttcattagacaacattgacccttaccaagctgacattgctgaacctgcaaaggcatcaccaatgaacatcaagctgaatgcaaccaactacatcagcccagctactcgtaagaaaatggatcaatcattagcttcgggcaacgtcaccgaaaagactgagattattgaagtgaaagttgaagtcgagaaaatcgtggaaaaagaagtgattaaaacagaaatcgttgaagtacctgtggctgctcctcaagcttcaaatgtacaacagtcaactgctccagcaccaagtgcacaagtagtaacagcagctcagcagccacaagtggcgcaacctgcaccagcgactatccagccagcagctcaagtaacggttgatgagtcttcactgcaatcgttcttcaatgctcaacaacaagcagcagaagtacatcagcaattcttggcgattcctcagcaatacggtgacacattcaataccctaatgtctgagcaagcgaaaatggcaacagcaggcgtagcaattcctgagaacctgcaacgttctatggaaatgttccaccagcaccaagctgaaacgctaaaagctcacgctcattacctagagatgcaagcacacagcaacaactcagcacttaatatgctgacgcaaggttcagcacaaacggcacaaccaaccttcgttgcgccagtaaatgctcagccagcgattcaagcgactccaacaactatcgttcaacagcctgtagctcaagtacaagcgactcctttacaagccgcgccagttcaagctcagtctgttcaagttacgccagtacagaaagcagctcctgcaccacaagtagtggctcaagcggcagcgcctgttgcagctcagcctgtgccagttaaagcacaaccagctcctgtggctgcaccagtagcagtacaatcagccgatgctgaaaaagtgatgctagaagtagtcgctgagaaaacaggttacccaacggagatgcttgatctagaaatggacatggaagcagaccttggtatcgactcaatcaagcgcgtagagattcttggtaccgttcaagacgaaatgccaaacctacctgagctgaaccctgaagatttagctgagtgtcgtactcttggtgaaatcgtcgagtacatgaacagcaagatgccagcatcagcgcctgttgcagcacagccaagcgctactgctcctgttcaagccgctaacggtcttgatgcgaaaatcgttcaacaaaccatgctagaagtggttgctgagaaaacaggttacccaacggaaatgcttgatctagaaatggatatggaagcagaccttggcatcgactcaatcaaacgtgttgagattcttggtacggttcaagatgaactgcctactcttccagagctaaaccctgaagacttagctgagtgtcgtacacttggcgaaatcgttgcttacatgaacagcaagcttccagcttctgctcccgtggcttcacaagcagcagtagttgctccggcagcagctagcaatggtctagatgcggctgtcgttcaaaaaaccatgttagaagtagtggcagagaagacgggctacccgactgaaatgctagacctagcaatggacatggaagctgaccttggtatcgattcaatcaaacgtgttgaaatcctaggtacggttcaagacgaattaccgactcttccagagctaaaccctgaagatctcgctgagtgtcgtactcttggcgaaatcgtagactatatgaacagcaagcttccagcttctgctccagtagcagctcaagcatctgtaccagcgcaagcagtctcaaacggtttaaacgctgagcaagttcaaagcacaatgctgagcgtagtagctgataaaactggctacccaacagaaatgctcgacctagcaatggacatggaagcagaccttggcattgactcaatcaaacgtgttgagatccttggtacggttcaagatcaactaccaacattgccagagctgaaccctgaagatctagctgagtgtcgtactctgggtgaaatcgttgactacatgaatagtaagctaggcgctactgctactacgagtacagaagtcgctgcagcaactgtagaaagcacgagcaatgacctaaatcctgctcacgttcaatcaaccatgatggaagtggttgccgacaaaacaggctaccccgcagaaatgctcgacctagcgatggacatggaagcagaccttggtatcgactcaatcaaacgcgttgagatcctaggtacagttcaagaccagctaccaacgctgccagaactgaaccctgaagacttagctgagtgtcgtacgcttggtgaaatcgttacctacatgcaaagtaagctatccgctgctgcacccgtagcaacttcaaaagctgaatcagtaacgcctatcgcagaaacagcgacagcggaacttcctccacacaatgaggtggcgctaaaaaagctaccagcggcagataaactcgtcgattgtttctcaaaagacgcttgtgtcgtgatcacagatgatggtcacaacgccggtgttctagcagaaaagttgaccgctaacggcattcaagttgctgtagtgcgtagtgctctttctgccgcgtcacctttaaacagtgaaatcgcaagctacaccctcaacagtatcgatgatgctggtgtgactgcggttattaacgacatcgaagcagaccttaaaacgtcgaacaaagtgattgctggcttcattcatttacaagctatcgttgatacgaaacaaagcaacgagcaagcggttaacttgaatgcagactcaagaacttcactgacaacagcgttcttattcgccaagcacctaaatggtcagctgaatgccgtttctggtcgtagcgtgttcttcacgctaagccgtatcgatggtggctttggttacctagatactaagcaattagcgaatgcagaacttaaccaagcggctctatctggtctaactaagacactgagccatgaatggtcaaacgtgttctgccgcgcattggatgctgacgcttcgattgatgctcgtcacctagctgaagctatcacaggcgaactgttcgatatcgataccaacacggttgaaatcggccttagccatgcggaaaacggggaatctggtcgtgcaacattgattgcgacaacaccaggtgctgcgcaaaccaaaaacacaggcgctcaactcaccaagagcgacaaagttctggtgacgggtggcgctaaaggcgtgacgtttgaatgtgcactgactcttgctaagcaatgtaagtctcacttcattcttgcaggtcgtagtaagcatattacttcagctgagctacctcagtgggcacaaggcaagcaagagaaagagttaaaaccagcggctatcgctcacctacaagcaacaggtgacaaaccaacgccgaagaaagttgatgccttgctaaaacctgtattgagtagccttgaaatcaacgcagcacttgccgctttcaacgagattggcgcgagcgctgaatacctaagcctagatgtatcgaaccatgagtcagtagcgaaaacgctggcgaatttcgaaggcatcacgggtcttatccacggtgcaggtgtactggctgacaaacacattcaagataaaacgcttgatgaactgaacatggtttacggcacaaaagtgggcggactagaagcagttcttggcggtcttgatagcagcaagctaaaactgattgcgatgttctcttcggcggcgggtttctacggaaacacaggccaaagcgattactcgatgtctaacgagatcctaaacaaagcggctctgcaattgtcagcgcgtaaccctcaagcgaaagtaatgagcttcaactggggaccgtgggacggtggcatggtaaacgcagcactgaaacgtatgttcacagagcgtggtgtgtacgtgattcctcttcaggcgggtgcagagctgtttagttctcagctactgaacgaaactggcattcaattgctggttggcacgagcatgcaaggttctgacaacaaggaagctgctgtaaaaaagcttaatgcggagtctgtgcatcttgcaaagagtccgctgaatacaagcatcactgtgacacgtcatcttgatccgaaggcattgcctttcattcaagatcactgcattgccggtaacccagtgttaccgacagtgtgtgccatccaatggatgcgtgaagtcgctgagcaactgttaggggtgaacgttagcgttcacaactacaaactgctgaaaggtgtgatttttgatactgatgaagtgcaagagctaacgcttgtcttgtctacagaggctaaatcaaaaggtcagctaaaagcagcaatcagttgccaagggcgaccacagtatcaagctcagttgcaagttgcctctgtgcaagtgtctgaagatgttcaacaagcgtcgacaaaacgctttgaagctaactcttcaacaccagtaacaacggcacaagctctatacagcgacggcactctgtttcacggaccaagactgcaaggtattacctcagttgaacgctttgacgacttaggcttactggctcagtgccaattgcctcagattgaaaacagcgactgcggagcatttattcctaaacaaggttttggcgatagtcagccatttgctgaagattatctgttgcaagcaatgctggtatgggctcgattgaaatacggcgcggcaagcctaccgtctgcaatcggtgagtttgtttgttacgcaccgatgcacgatggtgaccaaggttggctagagctgagcgtgataaaaagcacggctcgttctctgcaagctgatatctcgctttaccaccaagatggtcgtttaagtgcggtaatgaaaggtgcaaaagtcaccatcagcaagagcttaaacgacgcatttttgccgaagtctagctcagcagtatcgaagaaagaggcgactaagaacgcagaaaaggagcaattgtcatag

SEQ ID NO: 78 - protein, 2606 aa, Artificial Sequence
  Unknown Vibrio sp. isolate SGI-i1609
  misc_feature: PfaA polypeptide
  misc_feature: SGI Peptide ID NO. 1551532
  misc_feature: Useful for modulating production of PUFA
  misc_feature (2)..(1647): NCBI GI: 24373171 Blast Desc: beta keto-acyl synthase [Shewanella oneidensis MR-1] gi|24347382|gb|AAN54658.1|AE015606_4 multi-domain beta-ketoacyl synthase [Shewanella oneidensis MR-1]
  misc_feature (2)..(1435): NCBI GI: 336310880 Blast Desc: omega-3 polyunsaturated fatty acid synthase subunit, PfaA [Shewanella sp. HN-41] gi|335865560|gb|EGM70576.1| omega-3 polyunsaturated fatty acid synthase subunit, PfaA [Shewanella sp.
  misc_feature (3)..(1748): NCBI GI: 71277928 Blast Desc: polyunsaturated fatty acid synthase PfaA [Colwellia psychrerythraea 34H] gi|71143668|gb|AAZ24141.1| polyunsaturated fatty acid synthase PfaA [Colwellia psychrerythraea 34H]
  misc_feature (11)..(1740): NCBI GI: 149909575 Blast Desc: polyunsaturated fatty acid synthase PfaA [Moritella sp. PE36] gi|149807279|gb|EDM67232.1| polyunsaturated fatty acid synthase PfaA [Moritella sp. PE36]
  misc_feature (14)..(1732): NCBI GI: 93209538 Blast Desc: polyunsaturated fatty acid synthase [Pseudoalteromonas sp. DS-12]
  misc_feature (24)..(301): Pfam Id: PF00109 Pfam Desc: Beta-ketoacyl synthase, N-terminal domain
  misc_feature (309)..(426): Pfam Id: PF02801 Pfam Desc: Beta-ketoacyl synthase, C-terminal domain
  misc_feature (599)..(906): Pfam Id: PF00698 Pfam Desc: Acyl transferase domain
  misc_feature (1233)..(2586): NCBI GI: 93209538 Blast Desc: polyunsaturated fatty acid synthase [Pseudoalteromonas sp. DS-12]
  misc_feature (1234)..(2581): NCBI GI: 149909575 Blast Desc: polyunsaturated fatty acid synthase PfaA [Moritella sp. PE36] gi|149807279|gb|EDM67232.1| polyunsaturated fatty acid synthase PfaA [Moritella sp. PE36]
  misc_feature (1244)..(2603): NCBI GI: 71277928 Blast Desc: polyunsaturated fatty acid synthase PfaA [Colwellia psychrerythraea 34H] gi|71143668|gb|AAZ24141.1| polyunsaturated fatty acid synthase PfaA [Colwellia psychrerythraea 34H]
  misc_feature (1247)..(1314): Pfam Id: PF00550 Pfam Desc: Phosphopantetheine attachment site
  misc_feature (1345)..(2597): NCBI GI: 24373171 Blast Desc: beta keto-acyl synthase [Shewanella oneidensis MR-1] gi|24347382|gb|AAN54658.1|AE015606_4 multi-domain beta-ketoacyl synthase [Shewanella oneidensis MR-1]
  misc_feature (1348)..(1416): Pfam Id: PF00550 Pfam Desc: Phosphopantetheine attachment site
  misc_feature (1451)..(1518): Pfam Id: PF00550 Pfam Desc: Phosphopantetheine attachment site
  misc_feature (1535)..(2584): NCBI GI: 336310880 Blast Desc: omega-3 polyunsaturated fatty acid synthase subunit, PfaA [Shewanella sp. HN-41] gi|335865560|gb|EGM70576.1| omega-3 polyunsaturated fatty acid synthase subunit, PfaA [Shewanella sp.
  misc_feature (1552)..(1619): Pfam Id: PF00550 Pfam Desc: Phosphopantetheine attachment site
  misc_feature (1655)..(1720): Pfam Id: PF00550 Pfam Desc: Phosphopantetheine attachment site
  misc_feature (2015)..(2236): Pfam Id: PF08659 Pfam Desc: KR domain
  misc_feature (2100)..(2219): Pfam Id: PF00106 Pfam Desc: short chain dehydrogenase
MSQPETNTPESVDDTRLNKRLKDMPVAIVGMASMFANSRYLNKFWDLISEKIDAITEVPDTHWRPEDYYDSDRTTPDKSYCKRGGFIPEVDFNPMEFGLPPNILELTDTSQLLSLIVAKEVLEDAKLPEGYDRDKIGITLGVGGGQKIAQSLNARLQYPVLKKVFKSSGINDEDSEMLIKKFQDQYIHWEENSFPGSLGNVISGRIANRFDLGGINCVVDAACAGSLAAMRMALSELVEGRSEMMITGGVCTDNSPTMYMSFSKTPAFTTNETIQPFDIDSKGMMIGEGIGMVALKRLEDAERDGDRIYSVIKGVGSSSDGKFKSIYAPRPEGQAKALKRAYDDAGFAPHTLGLLEAHGTGTAAGDVAEFGGLNSVFSENNEEKQHIALGSVKSQIGHTKSTAGTAGLIKAALALHHKVLPPTINVSAPNPKLDIENSPFYLNTQTRPWMKRVDGTPRRAGISSFGFGGTNFHVVLEEYTPEHARGDKYRQRQVPQTLLFSAESRQALINELKQVSTQAADAAFKLEALAEQHALREVDAKHARIGLVVTDQADLQAQLTQAVSMLESQTKTHWQMPNGTSYRESALIAENGAGKVAALFAGQGSQYLNMGRELACHYPEMRQQLAQADQVFGQHKKTALSQILFPIPTFTPEATKAQEAVLTNTANAQSAIGTVSMGQFDIMTQAGFKADMVAGHSFGELSALCASGVISQDDYYQLAFARGDAMAATPEQGDSGTMFAVILDADKLPAVESCISQFEGVSIANYNAPTQLVIAGPTATVQQAAQALTEQGFKAIALPVSGAFHTPLVAHAQKPFAAAIDKASFSAPTLPLYSNATGKLHSKDAKAIKKAFKQHMLQSVRFSEQIEAMYEAGARVFVEFGPKNILQKLVEKTLADKNEELYAISINPSPKGDSDQQLRLAAVQLCVAGVSLDNIDPYQADIAEPAKASPMNIKLNATNYISPATRKKMDQSLASGNVTEKTEIIEVKVEVEKIVEKEVIKTEIVEVPVAAPQASNVQQSTAPAPSAQVVTAAQQPQVAQPAPATIQPAAQVTVDESSLQSFFNAQQQAAEVHQQFLAIPQQYGDTFNTLMSEQAKMATAGVAIPENLQRSMEMFHQHQAETLKAHAHYLEMQAHSNNSALNMLTQGSAQTAQPTFVAPVNAQPAIQATPTTIVQQPVAQVQATPLQAAPVQAQSVQVTPVQKAAPAPQVVAQAAAPVAAQPVPVKAQPAPVAAPVAVQSADAEKVMLEVVAEKTGYPTEMLDLEMDMEADLGIDSIKRVEILGTVQDEMPNLPELNPEDLAECRTLGEIVEYMNSKMPASAPVAAQPSATAPVQAANGLDAKIVQQTMLEVVAEKTGYPTEMLDLEMDMEADLGIDSIKRVEILGTVQDELPTLPELNPEDLAECRTLGEIVAYMNSKLPASAPVASQAAVVAPAAASNGLDAAVVQKTMLEVVAEKTGYPTEMLDLAMDMEADLGIDSIKRVEILGTVQDELPTLPELNPEDLAECRTLGEIVDYMNSKLPASAPVAAQASVPAQAVSNGLNAEQVQSTMLSVVADKTGYPTEMLDLAMDMEADLGIDSIKRVEILGTVQDQLPTLPELNPEDLAECRTLGEIVDYMNSKLGATATTSTEVAAATVESTSNDLNPAHVQSTMMEVVADKTGYPAEMLDLAMDMEADLGIDSIKRVEILGTVQDQLPTLPELNPEDLAECRTLGEIVTYMQSKLSAAAPVATSKAESVTPIAETATAELPPHNEVALKKLPAADKLVDCFSKDACVVITDDGHNAGVLAEKLTANGIQVAVVRSALSAASPLNSEIASYTLNSIDDAGVTAVINDIEADLKTSNKVIAGFIHLQAIVDTKQSNEQAVNLNADSRTSLTTAFLFAKHLNGQLNAVSGRSVFFTLSRIDGGFGYLDTKQLANAELNQAALSGLTKTLSHEWSNVFCRALDADASIDARHLAEAITGELFDIDTNTVEIGLSHAENGESGRATLIATTPGAAQTKNTGAQLTKSDKVLVTGGAKGVTFECALTLAKQCKSHFILAGRSKHITSAELPQWAQGKQEKELKPAAIAHLQATGDKPTPKKVDALLKPVLSSLEINAALAAFNEIGASAEYLSLDVSNHESVAKTLANFEGITGLIHGAGVLADKHIQDKTLDELNMVYGTKVGGLEAVLGGLDSSKLKLIAMFSSAAGFYGNTGQSDYSMSNEILNKAALQLSARNPQAKVMSFNWGPWDGGMVNAALKRMFTERGVYVIPLQAGAELFSSQLLNETGIQLLVGTSMQGSDNKEAAVKKLNAESVHLAKSPLNTSITVTRHLDPKALPFIQDHCIAGNPVLPTVCAIQWMREVAEQLLGVNVSVHNYKLLKGVIFDTDEVQELTLVLSTEAKSKGQLKAAISCQGRPQYQAQLQVASVQVSEDVQQASTKRFEANSSTPVTTAQALYSDGTLFHGPRLQGITSVERFDDLGLLAQCQLPQIENSDCGAFIPKQGFGDSQPFAEDYLLQAMLVWARLKYGAASLPSAIGEFVCYAPMHDGDQGWLELSVIKSTARSLQADISLYHQDGRLSAVMKGAKVTISKSLNDAFLPKSSSAVSKKEATKNAEKEQLS

SEQ ID NO: 79 - DNA, 2049 bp, Vibrio sp.
  misc_feature: PfaB gene
  misc_feature: SGI cDNA ID NO. 1551534
  misc_feature: Encodes the peptide sequence at SEQ ID NO 80
  misc_feature: Useful for modulating production of PUFA
gtgactgttcctactaataaagcgatgccattgcgcatcgctcttttagctcagccagcaaacgcggctgagctttctgccgacttatcaccttcgcttccagaggtgcttactgttgtggttgatggcaattttaatcaagcacttgctcacgccatcgagacagtcaatcaaggtaatgttgttaagctttgtttggattctcattctccatcattagtgatgttgagcgcgttgacggctgctcaaaacaagattcatccacacgcttatctagcgggttttgcagatacagctaccggagatagcgttcagcttgctctagagatgtcacgccgtcccgcttcagatttaagtcatcaacagcaacactctgacttatcggcttcgcagcagtttgatgaattgttgaatatagttaatgcgatatcgagccgttcattaccgagcgattcattacctaaccattactggttcactgagccgaacaaagcacgtgttgctgcgttaactttcagtgacgatagccaaaaagccaccagtctgatattgacgcaagcgaccggttttcaagaaccaaaacccttgctatcgagcgagcgtttgatgtttgtggtttcaggcaacgaaaaagccgaattggtttctcagctagcttcactaagagaagagcttaaatgcgttagtgattcatcggacagcgaacttgctatcgccaccctgatgcattcaaacctaagccacttccaaagcattcaacacaatgctggtcttagcgcgaacatagtgattcaagcggcttcaattgatgctgcattgcaagaaatcacagcgctagaaaatgcgctgccaaaagtaatggctgacaatagccaatacaaaactccggcaggcagttgtttctctccaaagcctcaaagcaaaggtggcgttgcatttgtttaccctggtgttggcacggtttatcccggcatgttgcgcgagtttcaccaccatttcccacagttatttgctcgcttagaacgcgaaggtaacttgaaagagatgctacaggctgaaaaaacctacgctgaggactcgcaagagatgtcgctcagcgagctggcaattgcaggtgtgggcagcagttatctgttaacacaactgctatgtgatgaattcaaagtgcagccagatttcgccttgggctactccaaaggtgaagcttccatgtgggccagcttaaatgtttggaaaaaaccacatgcgctgatcgagatgactcaaaccagtcctatcttcaccactgctatttctggcgaactcaccgcagtgcgtcaagattggcagctgaatggcaacgaaagcatccaatggaatagctttgtggttcgcagtgatgcacaagcgattgaggctctgttaccagaattcccacgcgcttatctcgctatcatccaaggtgacacctgcgtactggctggttgtgaaagcacctgtcgtgcactactcaaaaaactaggtaaacgtggcattgccgcgaatcgtgttaccgcaatgcacactacaccagcattgagccaacatagccaagtgcgtgagttttacacgcaaccactgttcaacgagttgccaaagcatatccgctttatcagcgcagcaggtctaccgacgggcgccccagtcaatatagacagcgacagcatcgccctttcaattgctgatactttctgttcaacgttagatttcaccgcgttgatccaaagtgcgcgtcaacaaggtgcgcgtctgtttgtagaagtaggtgccgatcgtcaaaccagcacattgatcgacaagatcaatcgtagcgacgacgtagccgaccagtgctgcacaatcgcttccaatgccaaaggcggtgacgatgttgtcacgctcatcaagtgcattggtcagctcattactcatcaaatcccactgtctgtcgagccacttattcaaggcctagaacaacagatcaccgcagctaagcaattaagcggtttgtctcaaggcagcgcagtgaatcatcaaggagagctagtatga

SEQ ID NO: 80 - protein, 682 aa, Vibrio sp.
  misc_feature: PfaB polypeptide
  misc_feature: SGI Peptide ID NO. 1551534
  misc_feature: Useful for modulating production of PUFA
  misc_feature (1)..(682): NCBI GI: 86147636 Blast Desc: omega-3 polyunsaturated fatty acid synthase PfaB [Vibrio sp. MED222] gi|85834547|gb|EAQ52696.1| omega-3 polyunsaturated fatty acid synthase PfaB [Vibrio sp. MED222]
  misc_feature (1)..(682): NCBI GI: 84387724 Blast Desc: omega-3 polyunsaturated fatty acid synthase PfaB [Vibrio splendidus 12B01] gi|84377407|gb|EAP94274.1| omega-3 polyunsaturated fatty acid synthase PfaB [Vibrio splendidus
  misc_feature (1)..(682): NCBI GI: 218710184 Blast Desc: omega-3 polyunsaturated fatty acid synthase PfaB [Vibrio splendidus LGP32] gi|218323203|emb|CAV19380.1| PfaB, omega-3 polyunsaturated fatty acid synthase [Vibrio splendidus
  misc_feature (1)..(682): NCBI GI: 325974044 Blast Desc: omega-3 polyunsaturated fatty acid synthase PfaB [Vibrio sp. NSP560]
  misc_feature (1)..(682): NCBI GI: 90413868 Blast Desc: omega-3 polyunsaturated fatty acid synthase PfaB [Photobacterium profundum 3TCK] gi|90325052|gb|EAS41562.1| omega-3 polyunsaturated fatty acid synthase PfaB [Photobacterium
  misc_feature (1)..(682): NCBI GI: 325974054 Blast Desc: omega-3 polyunsaturated fatty acid synthase PfaB [Photobacterium sp. MA665]
  misc_feature (1)..(682): NCBI GI: 15488032 Blast Desc: AF409100_8 omega-3 polyunsaturated fatty acid synthase PfaB [Photobacterium profundum SS9]
  misc_feature (9)..(682): NCBI GI: 325974034 Blast Desc: omega-3 polyunsaturated fatty acid synthase PfaB [Shewanella sp. MAR441]
  misc_feature (9)..(682): NCBI GI: 54308652 Blast Desc: omega-3 polyunsaturated fatty acid synthase PfaB [Photobacterium profundum SS9] gi|46913081|emb|CAG19870.1| omega-3 polyunsaturated fatty acid synthase PfaB [Photobacterium
  misc_feature (9)..(681): NCBI GI: 212636305 Blast Desc: Omega-3 polyunsaturated fatty acid synthase PfaB [Shewanella piezotolerans WP3] gi|212557789|gb|ACJ30243.1| Omega-3 polyunsaturated fatty acid synthase PfaB [Shewanella WP3]
  misc_feature (155)..(655): Pfam Id: PF00698 Pfam Desc: Acyl transferase domain
MTVPTNKAMPLRIALLAQPANAAELSADLSPSLPEVLTVVVDGNFNQALAHAIETVNQGNVVKLCLDSHSPSLVMLSALTAAQNKIHPHAYLAGFADTATGDSVQLALEMSRRPASDLSHQQQHSDLSASQQFDELLNIVNAISSRSLPSDSLPNHYWFTEPNKARVAALTFSDDSQKATSLILTQATGFQEPKPLLSSERLMFVVSGNEKAELVSQLASLREELKCVSDSSDSELAIATLMHSNLSHFQSIQHNAGLSANIVIQAASIDAALQEITALENALPKVMADNSQYKTPAGSCFSPKPQSKGGVAFVYPGVGTVYPGMLREFHHHFPQLFARLEREGNLKEMLQAEKTYAEDSQEMSLSELAIAGVGSSYLLTQLLCDEFKVQPDFALGYSKGEASMWASLNVWKKPHALIEMTQTSPIFTTAISGELTAVRQDWQLNGNESIQWNSFVVRSDAQAIEALLPEFPRAYLAIIQGDTCVLAGCESTCRALLKKLGKRGIAANRVTAMHTTPALSQHSQVREFYTQPLFNELPKHIRFISAAGLPTGAPVNIDSDSIALSIADTFCSTLDFTALIQSARQQGARLFVEVGADRQTSTLIDKINRSDDVADQCCTIASNAKGGDDVVTLIKCIGQLITHQIPLSVEPLIQGLEQQITAAKQLSGLSQGSAVNHQGELV

SEQ ID NO: 81 - DNA, 5964 bp, Vibrio sp.
  misc_feature: PfaC gene
  misc_feature: SGI cDNA ID NO. 1551536
  misc_feature: Encodes the peptide sequence at SEQ ID NO 82
  misc_feature: Useful for modulating production of PUFA
atgagttctcaatcgaaaccatctcaatatcaggctcaaaacaagcagcaagtgaagtgcaataagatcgcgattgttggtattgctaaccaatacccagaagcggatacgccaaaagacttttggcaaaacttgctgaataaaaaagattctcgaaccacattaagcgctgaaaaattaggggctaaacctgaaagctatcagggcgtacaaggcgagtcagaccgcttttactgtgacaaaggcggctacatcgaaaacttcaatttcgatagcaatggctaccgcttaacagcagaatcattcaacggtgttgaccaaagtttcctatgggctttggataccagtcgtaaggcgttaatcgacgcaggcattgatctgaatgccgatattttagagcgtacaggcgtgatcatgggtgccctttcgttcccaaccacacgctcgaacgacctgtttctgccgatgtatcactcagtggtcgaaaaggcactacaagctaaattggctaatgaccagttttcattgctaccaaccaatgaaaccgcgcaaaaccttaatccgatcaatggtgctgcagcacacaacgcctctaagttagtggctgatgcgctaggtttaggcaacgtgcaacttagcttagatgcggcatgtgcaagctcagtgtattcattgaagttagcgtgtgattacttgaacacaggcaaagccgacatgatgttggcaggtgcggtatcaggtgctgacccattctttatcaatatgggtttttccatcttccacgcttaccctgatcacggtgtatcggttccgtttgatagcaacagtaaaggtctgtttgctggcgaaggtgccggtgttttagtcctaaaacgcttagctgatgcagaacgtgatggcgacaatatctatgcagttgtcagcggtattggcttgtcgaacgatggccgtggccagttcgtattaagcccaaacagcaaaggacaagtacaagcctttgaacgcgcttacgaggcttcaaacctatcaccagacagcattgaagtgattgagtgtcacgcaaccggcacaccattaggtgacaaggttgagttaacctcaatggagcgtttctttgctgacaaattgaatggttctaacccgccattgattggctctgcgaagtcaaacctcggccacttactgactgctgcgggtatgccggggatcatgaagatgatctttgcgatgaaagaaggcgtgcttcctccaagtattaatttggacaagccactgtcttcaccagaaggtttatttggttcacagaccctaccaacacaggttcaaccttggccaagtaaaacgggcaaccaagagcgctgtgcgggtgtttctgtatttggtttcggtggttgtaatgctcacttactgcttgaagcgtattcagacaccagtcatgtaaaccagactctagagtcagcgtctccaagcctacagccgtctaatttaagcattactggcctcgcgtctcacttcggttctctgcaaagcatcaatgcgctaagcactgcgattgaaaccaacaacgatgctttcattgctttgcctaagaaacgctggaaaggcttagaccaacatccagaactactgaatcagtttggtttacacggcattccaaacggagcgtacatcgatcaattcgatctcgatttcctacgctttaaagtgccgccgaatgaagatgaccgtttgatctctcagcagttgctactgatgaaagttgcagacgaagcgatcaaagatgccaagcttgttgctggccaaaaggttgcagtactcgttgcgatggaaacagagcttgagatgcaccaattccgtggacgcgtaaacctgcatagccaattggctgacagctttgccaacatgggtattgagctaacacatgacgaataccaatcgctagaaaccatcgcgatggacagtgtgatggacgcagccaagctgaaccaatacaccagtttcatcggcaacatcatggcttcgcgtatctcttcattgtgggactttaacggcccagcctttacgatttcagctgctgaacagtcagttgctcgttgtatcgatgtcgcacaaaacctgatgtctcaagaatcaatggatgccgttgtaattgcagccgttgaccttagtggcagtgcagaacatgtgattctgaagaacagcgtgagcccagtgtcacttgctccaaaattcggacaaccgcaagacggcagttggaatgtgggcgaaggagcaggtgcgattgttcttgttgaagagagtcgagtggcgagcaaccaagatacggcttacggcagtatctacgcattggcctttggttcaagcgagcgtaacaatgccgttgctgatgagttactgactcaagtcggtatgagctcaaacgatgtttctctgcttgagcttaaccatgcacctgaatcttcattacatcagtcttcgtctctaagtttagggagcacaaagacaactcaagcaagtcagcgtgtgggtcactgctctgcagcttctggcatggcaagcctgctacacggcctgctcaacctgaaccttgagtctctgaatccaaatgtcagctctaagagcgcgattgttgccaacatcagcgaaggacaatgttcacagctgttactgagccaatcgagtgttgaatctcagtcactgtcggttcgtttaagcaatgaactggcgagtgatgctaagcgccaattggttaagcaagtgactcttggtggtcgcgatatctatcaacatattgccgaaaccccagtaactagcttggcaacgattcagcagaaagcttctggcaaacaagcagcaagagtggcgtcgattccaacgacagcaagcattcaagcagcccttgtgcaaaaagagttagagaagaaagcattagcgcagaacgcggtagaaccagtattcgaaactcctacatcagtatcccctactctggcgccaactcgccacagtcagctaacaggtaaccacagcaatatgactcatgtcctatccgctaaaaatggcgcgtctcaaatcgacgcagcttcacaacagccacaaaatctaagccaagatcaggtaagccaaaaccaagcttttgctcaaaatcagcaagcagctcaacaggtacacaaagcattcctgcacactcgtgcccaaggcatgcagatggctgatgcgctattaaaagcacagctaaacgcagtgacatctggtttagatagctcaagtttagagaacaattccatttctcaacaaacaaatggtcagcaaacatcagctcagcctgttcaagctcaaccagctcaggttcagtcagcgccggtaaacgtacttgcgacgccagcaccagtaaaacctatccgtaaaccatgtatctgggattacgatgatctggttgaatacgctgaaggcgacatcgccaatgtatttggccctgactacgcgatcatcgatagctactcgcgccgcgttcgcctaccaaccacagactacctattggtatctcgtgtaaccaagctcaacgcaaccgttaacgaatacaagccaagcaccatgaccacagaatacgacatcccagttgatgcaccgtatcttgttgatggtcaaatcccttgggctgtagcggtagaatctggtcagtgtgacctaatgctgatcagctacttaggtatcgattttgaaaacaagggcgaacgtgtttatcgtctgcttgattgcacattaactttccttggtgacttgcctcgtggtggcgatacgctgcgttacgatatctcaatcaacaactttgctcgcaatggcgacacgctactgttcttcttctcgtacgaatgtttcgttggcgacaagatgatcctgaaaatggataacggctgtgcgggcttcttcactgatgaagagctagccgatggcaagggcgtgattcacactgaagatgaaatcaaggctcgtaaacttgccactaagcaacgtttcgaccctatgttgcactgccctaaaacccagtttaaccaccaagaactgcgccacctactgactgcaaacattgcagagtgttttggtccaactcaccaatccaatcgccaccagccttctttgtgcttcagctcagagaagttcatgatgatcgaaaaggttagccgcgttgaaccacaaggcggcacatggggacttggtctgattgaaggtcacaaacagcttgagcctgagcactggtacttcccttgtcacttcaaagatgactcagtaatggctggctctttgatggcagaaggttgtggtcaactgcttcaattcttcatgatgcaccttggcatgcacacgcttgttcaaaatggtcgtttccaaccgcttgaaaatgcccctcaacaagtacgttgtcgcggtcaagttctaccgcaatcggcagaactgacttaccgcatggaagtgaccgagattggtctaagccctcgtccatacgcgaaagccaacatcgatattttgctcaacggcaaagtgattgttgatttccaaaacttgggtgtgatgatcaaagaagacgacgaatgtactcgttatctgccttctttagaatcagctgtcgcgatccctgttatcgaaagcttggaccataaaagcttgggccatacaccagcagtgaaccaacaggcttcagctaatgcgccactgatggcgcaaattgaagatctagaaacagcgccaaataaaggtgtggttcctcttcaacacgttgaagctccggtaacgcctgattacccgaaccgcacacccgatacggtcccgttcacgccataccatatgttcgaattcgcgactggcgatatcgagaaatgtttcggtcctgatttctctatctaccgtggcatgatcccaccacgtactccgtgtggcgacctacagctaaccactcgtgttgttgagatcgacggtaaacgtggcgacttcaagaagccttcatcgtgtatcgcagagtacgaagtgccagaaaacgcatggtactttgatgaaaacagccaccacaccttgatgccttactcggtattgatggagatttcactgcagccaaacggctttatctctggctacatgggaacaacattgggcttcccaggtgaagaactgtttttccgtaacctagacggtagcggcaaaatgctgcgtaacgtcgacttgcgcggcaaaacgattaccaacgattctcgcctgctttcaacagtaatgatgggcactaacatcgtacagagcttcagcttcgaactgagcactgacggcgtgcctttctaccaaggtaccgcggtatttggttacttcaagggtgcagcattgaaagatcagctcggtttggacaacggtaaagtaactcacccttggcacgttgataacaaccgcacgccggatgtacacatcaacctactggacaaaacgacgcgttacttcaatgcacccgtttctgctactggtgaagtgcaagagcactaccaactggctggcggtcgtttgaactttatcgatacggtgcagatcaccagcgatggtggtaaagacggtcttggttacctatacgctgagcgtacgattgacccaagcgattggttcttccagttccacttccatcaagatccggtaatgccaggctctctaggtgtcgaagcgatcatcgagttaatgcaaacctatgcgctaaacaaagatcttggcgctggtttccgcaatccgaagtttggtcaaatccaatcggaagtgaaatggaaataccgtggtcagattaaccctctgaacaaacagatgtctctggatgtacacatcactgcgattaaagacgaagacggcaaacgcatcatcgttggcgacgcaaatctgagcaaagatggtctgcgtatttacgaagtgaaagacatcgcaatttgtatcgaagaagcataa

SEQ ID NO: 82 - protein, 1987 aa, Vibrio sp.
  misc_feature: PfaC polypeptide
  misc_feature: SGI Peptide ID NO. 1551536
  misc_feature: Useful for modulating production of PUFA
  misc_feature (1)..(1987): NCBI GI: 86147637 Blast Desc: omega-3 polyunsaturated fatty acid synthase PfaC [Vibrio sp. MED222] gi|85834548|gb|EAQ52697.1| omega-3 polyunsaturated fatty acid synthase PfaC [Vibrio sp. MED222]
  misc_feature (1)..(1987): NCBI GI: 218710185 Blast Desc: omega-3 polyunsaturated fatty acid synthase PfaC [Vibrio splendidus LGP32] gi|218323204|emb|CAV19381.1| PfaC, omega-3 polyunsaturated fatty acid synthase [Vibrio splendidus
  misc_feature (1)..(1987): NCBI GI: 84387723 Blast Desc: omega-3 polyunsaturated fatty acid synthase PfaC [Vibrio splendidus 12B01] gi|84377406|gb|EAP94273.1| omega-3 polyunsaturated fatty acid synthase PfaC [Vibrio splendidus
  misc_feature (5)..(1987): NCBI GI: 54308651 Blast Desc: omega-3 polyunsaturated fatty acid synthase PfaC [Photobacterium profundum SS9] gi|46913080|emb|CAG19869.1| omega-3 polyunsaturated fatty acid synthase PfaC [Photobacterium
  misc_feature (12)..(1987): NCBI GI: 90413867 Blast Desc: omega-3 polyunsaturated fatty acid synthase PfaC [Photobacterium profundum 3TCK] gi|90325051|gb|EAS41561.1| omega-3 polyunsaturated fatty acid synthase PfaC [Photobacterium
  misc_feature (12)..(1987): NCBI GI: 325974036 Blast Desc: omega-3 polyunsaturated fatty acid synthase PfaC [Shewanella sp. MAR441]
  misc_feature (21)..(296): Pfam Id: PF00109 Pfam Desc: Beta-ketoacyl synthase, N-terminal domain
  misc_feature (23)..(1454): NCBI GI: 290475945 Blast Desc: 3-oxoacyl-ACP synthase [Xenorhabdus bovienii SS-2004] gi|289175273|emb|CBJ82076.1| 3-oxoacyl-[acyl-carrier-protein] synthase [Xenorhabdus bovienii SS-2004]
  misc_feature (304)..(422): Pfam Id: PF02801 Pfam Desc: Beta-ketoacyl synthase, C-terminal domain
  misc_feature (497)..(767): Pfam Id: PF00109 Pfam Desc: Beta-ketoacyl synthase, N-terminal domain
  misc_feature (1071)..(1984): NCBI GI: 389800868 Blast Desc: Short-chain dehydrogenase/reductase [Microcystis aeruginosa PCC 9807]
  misc_feature (1071)..(1984): NCBI GI: 389717015 Blast Desc: Short-chain dehydrogenase/reductase [Microcystis aeruginosa PCC 9717]
  misc_feature (1135)..(1984): NCBI GI: 166365528 Blast Desc: short-chain dehydrogenase/reductase [Microcystis aeruginosa NIES-843] gi|166087901|dbj|BAG02609.1| short-chain dehydrogenase/reductase [Microcystis aeruginosa NIES-843]
  misc_feature (1384)..(1517): Pfam Id: PF07977 Pfam Desc: FabA-like domain
  misc_feature (1846)..(1978): Pfam Id: PF07977 Pfam Desc: FabA-like domain
MSSQSKPSQYQAQNKQQVKCNKIAIVGIANQYPEADTPKDFWQNLLNKKDSRTTLSAEKLGAKPESYQGVQGESDRFYCDKGGYIENFNFDSNGYRLTAESFNGVDQSFLWALDTSRKALIDAGIDLNADILERTGVIMGALSFPTTRSNDLFLPMYHSVVEKALQAKLANDQFSLLPTNETAQNLNPINGAAAHNASKLVADALGLGNVQLSLDAACASSVYSLKLACDYLNTGKADMMLAGAVSGADPFFINMGFSIFHAYPDHGVSVPFDSNSKGLFAGEGAGVLVLKRLADAERDGDNIYAVVSGIGLSNDGRGQFVLSPNSKGQVQAFERAYEASNLSPDSIEVIECHATGTPLGDKVELTSMERFFADKLNGSNPPLIGSAKSNLGHLLTAAGMPGIMKMIFAMKEGVLPPSINLDKPLSSPEGLFGSQTLPTQVQPWPSKTGNQERCAGVSVFGFGGCNAHLLLEAYSDTSHVNQTLESASPSLQPSNLSITGLASHFGSLQSINALSTAIETNNDAFIALPKKRWKGLDQHPELLNQFGLHGIPNGAYIDQFDLDFLRFKVPPNEDDRLISQQLLLMKVADEAIKDAKLVAGQKVAVLVAMETELEMHQFRGRVNLHSQLADSFANMGIELTHDEYQSLETIAMDSVMDAAKLNQYTSFIGNIMASRISSLWDFNGPAFTISAAEQSVARCIDVAQNLMSQESMDAVVIAAVDLSGSAEHVILKNSVSPVSLAPKFGQPQDGSWNVGEGAGAIVLVEESRVASNQDTAYGSIYALAFGSSERNNAVADELLTQVGMSSNDVSLLELNHAPESSLHQSSSLSLGSTKTTQASQRVGHCSAASGMASLLHGLLNLNLESLNPNVSSKSAIVANISEGQCSQLLLSQSSVESQSLSVRLSNELASDAKRQLVKQVTLGGRDIYQHIAETPVTSLATIQQKASGKQAARVASIPTTASIQAALVQKELEKKALAQNAVEPVFETPTSVSPTLAPTRHSQLTGNHSNMTHVLSAKNGASQIDAASQQPQNLSQDQVSQNQAFAQNQQAAQQVHKAFLHTRAQGMQMADALLKAQLNAVTSGLDSSSLENNSISQQTNGQQTSAQPVQAQPAQVQSAPVNVLATPAPVKPIRKPCIWDYDDLVEYAEGDIANVFGPDYAIIDSYSRRVRLPTTDYLLVSRVTKLNATVNEYKPSTMTTEYDIPVDAPYLVDGQIPWAVAVESGQCDLMLISYLGIDFENKGERVYRLLDCTLTFLGDLPRGGDTLRYDISINNFARNGDTLLFFFSYECFVGDKMILKMDNGCAGFFTDEELADGKGVIHTEDEIKARKLATKQRFDPMLHCPKTQFNHQELRHLLTANIAECFGPTHQSNRHQPSLCFSSEKFMMIEKVSRVEPQGGTWGLGLIEGHKQLEPEHWYFPCHFKDDSVMAGSLMAEGCGQLLQFFMMHLGMHTLVQNGRFQPLENAPQQVRCRGQVLPQSAELTYRMEVTEIGLSPRPYAKANIDILLNGKVIVDFQNLGVMIKEDDECTRYLPSLESAVAIPVIESLDHKSLGHTPAVNQQASANAPLMAQIEDLETAPNKGVVPLQHVEAPVTPDYPNRTPDTVPFTPYHMFEFATGDIEKCFGPDFSIYRGMIPPRTPCGDLQLTTRVVEIDGKRGDFKKPSSCIAEYEVPENAWYFDENSHHTLMPYSVLMEISLQPNGFISGYMGTTLGFPGEELFFRNLDGSGKMLRNVDLRGKTITNDSRLLSTVMMGTNIVQSFSFELSTDGVPFYQGTAVFGYFKGAALKDQLGLDNGKVTHPWHVDNNRTPDVHINLLDKTTRYFNAPVSATGEVQEHYQLAGGRLNFIDTVQITSDGGKDGLGYLYAERTIDPSDWFFQFHFHQDPVMPGSLGVEAIIELMQTYALNKDLGAGFRNPKFGQIQSEVKWKYRGQINPLNKQMSLDVHITAIKDEDGKRIIVGDANLSKDGLRIYEVKDIAICIEEA

SEQ ID NO: 83 - DNA, 1638 bp, Vibrio sp.
  misc_feature: PfaD gene
  misc_feature: SGI cDNA ID NO. 1551538
  misc_feature: Encodes the peptide sequence at SEQ ID NO 84
  misc_feature: Useful for modulating production of PUFA
atgacaactcaaaccactatcaataacgaaaagctatctccgtggccttggcagatcgaagagagcacaacgcgtttcgataacgcagcaatgtcgacaatcttgaaagatttaagccttgcttgttacgtcgtgaaccacccagaaaaaggcttaggcgtaagccaacaagcagagattgcatcaggcgattcagcaagctcagcgaacaaccaacctgttagcgcatttgctccagctcttggtacacaaagcctaggcgacgaagattttcgtcgctgtcatggcgtgaaatacgcttactatgcaggcgcaatggcaaacggcatttcatctgaagagctagtaattgcccttggccaagctggcattctttgttcatttggcgcggcgggcttaatcccgtctcgtgttgagcaagcgattaatcgtattcaatcagcactgcctaacggcccttatgcgttcaacctaattcacagcccaagcgaacccgcgctagagcgcggcagtgttgagctgtttttgaagcacaaagtaaaaacggttgaggcttctgccttcttaggtctaacaccgcaaatcgttcactaccgtgcagctggccttagccgcgatgcacaaggtgagattcagattggcaacaaggttattgctaaggtaagccgtactgaagtcgcgagtaaattcatgcagcctgctcctgtaaaaatgctgcaggctctggttgatgaaggccgaatcacagcagagcaaatggaactggcacagctggttcctatggccgatgacatcactgcagaagccgattctggtggtcacaccgataaccgtccactggttaccctactgccaacgattcttgcactgaaagagcaaatccaagcacagtaccaattcaaaactccgctacgtgtcggttgtggtggtggcgtaggtacgcctgacgctgctctagcgacgtttaacatgggcgctgcttacattgttactggttcaatcaaccaagcgtgtgttgaggctggcgcgagcgagcacacacgtaagctactttcgacaaccgaaatggctgacgtgactatggctccggcggcagacatgttcgaaatgggagtgaaactgcaagtggttaagcgcggcactttattcccaatgcgtgccaacaaactgtatgagctatacacacgttatgactcaattgaagcgattccagtagaagagcgtctaaagcttgagaagcaagtcttccgttcaacactggatgatatttgggcagggactgtggctcactttaacgagcgagaccctaaacagatcgaacgagcggaaggcaacccgaaacgtaaaatggcgttgatcttccgttggtacttgggtctttcgagccgttggtcaaacaccggcgaacaaggtcgtgaaatggattaccaagtatgggcaggcccggcacttggcgcattcaacgcctgggcaaaagacagctatctagatgattaccaacagcgtaatgccgttgatcttgctaagcatctgatgcacggtgctgcgtacttagcacgtgttaacctgctgacttcgcaaggtatcaagcttgacccagaactagcacgttggaagccgacgcaaagaatggcatag

SEQ ID NO: 84 - protein, 545 aa, Vibrio sp.
  misc_feature: PfaD polypeptide
  misc_feature: SGI Peptide ID NO. 1551538
  misc_feature: Useful for modulating production of PUFA
  misc_feature (1)..(545): NCBI GI: 84387722 Blast Desc: omega-3 polyunsaturated fatty acid synthase PfaD [Vibrio splendidus 12B01] gi|84377405|gb|EAP94272.1| omega-3 polyunsaturated fatty acid synthase PfaD [Vibrio splendidus
  misc_feature (1)..(545): NCBI GI: 86147638 Blast Desc: omega-3 polyunsaturated fatty acid synthase PfaD [Vibrio sp. MED222] gi|85834549|gb|EAQ52698.1| omega-3 polyunsaturated fatty acid synthase PfaD [Vibrio sp. MED222]
  misc_feature (1)..(545): NCBI GI: 218710186 Blast Desc: omega-3 polyunsaturated fatty acid synthase PfaD [Vibrio splendidus LGP32] gi|218323205|emb|CAV19382.1| PfaD, omega-3 polyunsaturated fatty acid synthase [Vibrio splendidus
  misc_feature (1)..(545): NCBI GI: 325974048 Blast Desc: omega-3 polyunsaturated fatty acid synthase PfaD [Vibrio sp. NSP560] gi|325974058|emb|CCA30309.1| omega-3 polyunsaturated fatty acid synthase PfaD [Photobacterium sp.
  misc_feature (1)..(544): NCBI GI: 325974038 Blast Desc: omega-3 polyunsaturated fatty acid synthase PfaD [Shewanella sp. MAR441]
  misc_feature (1)..(544): NCBI GI: 90413866 Blast Desc: omega-3 polyunsaturated fatty acid synthase PfaD [Photobacterium profundum 3TCK] gi|90325050|gb|EAS41560.1| omega-3 polyunsaturated fatty acid synthase PfaD [Photobacterium
  misc_feature (1)..(544): NCBI GI: 54308650 Blast Desc: omega-3 polyunsaturated fatty acid synthase PfaD [Photobacterium profundum SS9] gi|15488034|gb|AAL01063.1|AF409100_10 omega-3 polyunsaturated
  misc_feature (1)..(544): NCBI GI: 219806610 Blast Desc: omega-3 polyunsaturated fatty acid synthase PfaD [Shewanella livingstonensis]
  misc_feature (6)..(545): NCBI GI: 170725781 Blast Desc: PfaD family protein [Shewanella woodyi ATCC 51908] gi|169811128|gb|ACA85712.1| PfaD family protein [Shewanella woodyi ATCC 51908]
  misc_feature (6)..(545): NCBI GI: 212557792 Blast Desc: Polyunsaturated fatty acid synthase PfaD [Shewanella piezotolerans WP3]
  misc_feature (93)..(366): Pfam Id: PF03060 Pfam Desc: Nitronate monooxygenase
MTTQTTINNEKLSPWPWQIEESTTRFDNAAMSTILKDLSLACYVVNHPEKGLGVSQQAEIASGDSASSANNQPVSAFAPALGTQSLGDEDFRRCHGVKYAYYAGAMANGISSEELVIALGQAGILCSFGAAGLIPSRVEQAINRIQSALPNGPYAFNLIHSPSEPALERGSVELFLKHKVKTVEASAFLGLTPQIVHYRAAGLSRDAQGEIQIGNKVIAKVSRTEVASKFMQPAPVKMLQALVDEGRITAEQMELAQLVPMADDITAEADSGGHTDNRPLVTLLPTILALKEQIQAQYQFKTPLRVGCGGGVGTPDAALATFNMGAAYIVTGSINQACVEAGASEHTRKLLSTTEMADVTMAPAADMFEMGVKLQVVKRGTLFPMRANKLYELYTRYDSIEAIPVEERLKLEKQVFRSTLDDIWAGTVAHFNERDPKQIERAEGNPKRKMALIFRWYLGLSSRWSNTGEQGREMDYQVWAGPALGAFNAWAKDSYLDDYQQRNAVDLAKHLMHGAAYLARVNLLTSQGIKLDPELARWKPTQRMA

SEQ ID NO: 85 - DNA, 834 bp, Vibrio sp.
  misc_feature: PfaE gene
  misc_feature: SGI cDNA ID NO. 1551521
  misc_feature: Encodes the peptide sequence at SEQ ID NO 86
  misc_feature: Useful for modulating production of PUFA
atgaaaacttccgttgttgatttgtggctatgttctctgagtaatttagatgaccagccagacaatgtatcgcagctcaaaaagagactgacagccgatgagatagctaaagttgagcgctatcgaatgccctcatctcaaattcaggctctgtatgttcgaaattacctaagaaaggtgctgtctcgctattctgatttgatgcctgaagcgtggcgctttgaatatggcgagaaaggaaagccaagtttagtcgccaaacagcaactcaagacggggttaaatttcaatattagtcatagcaaagaacatttgttgattgcagtttgccagagagaagggaagcaagttcaattgggtgttgatattgaacacgccagaagttcgaccaatatcgactcgatcatgaagcactacttttcaggtaaagaattggcggatttacttgagctcagcaaagaagagcagagagagcgttttttcgatctgtgggcgttgaaagagtcgtacatcaaagcgacgggtaaggggctagccacatcgttgcgaagcttttcgttcgaattctccaatctgacggagcaaacattgccaattcacgcttcggattttcagccaaatttgcaggatgaaattagattgtatcgcgaaatcaggctagatagcggggttggggtggatttggattcttatcaacaagacgatatttctacagattggcaatgttgcttgggtcgattagatgaccagtatcgtttcgccgtgacgcttggtggaaatttgctacccatgcagatagagatgagaaccttttcgtcgtctcatctcttttaa

SEQ ID NO: 86 - protein, 277 aa, Vibrio sp.
  misc_feature: PfaE polypeptide
  misc_feature: SGI Peptide ID NO. 1551521
  misc_feature: Useful for modulating production of PUFA
  misc_feature (1)..(277): NCBI GI: 86147634 Blast Desc: 4'-phosphopantetheinyl transferase family protein [Vibrio sp. MED222] gi|85834545|gb|EAQ52694.1| 4'-phosphopantetheinyl transferase family protein [Vibrio sp.
  misc_feature (1)..(277): NCBI GI: 84387726 Blast Desc: 4'-phosphopantetheinyl transferase family protein [Vibrio splendidus 12B01] gi|84377409|gb|EAP94276.1| 4'-phosphopantetheinyl transferase family protein [Vibrio 12B01]
  misc_feature (1)..(277): NCBI GI: 325974050 Blast Desc: omega-3 polyunsaturated fatty acid synthase PfaE [Vibrio sp. NSP560]
  misc_feature (1)..(277): NCBI GI: 218710182 Blast Desc: 4'-phosphopantetheinyl transferase [Vibrio splendidus LGP32] gi|218323201|emb|CAV19378.1| 4'-phosphopantetheinyl transferase [Vibrio splendidus LGP32]
  misc_feature (4)..(258): NCBI GI: 167624919 Blast Desc: 4'-phosphopantetheinyl transferase [Shewanella halifaxensis HAW-EB4] gi|167354941|gb|ABZ77554.1| 4'-phosphopantetheinyl transferase [Shewanella halifaxensis
  misc_feature (6)..(259): NCBI GI: 212636300 Blast Desc: 4'-phosphopantetheinyl transferase [Shewanella piezotolerans WP3] gi|212557784|gb|ACJ30238.1| 4'-phosphopantetheinyl transferase [Shewanella piezotolerans WP3]
  misc_feature (6)..(266): NCBI GI: 206570562 Blast Desc: 4'-phosphopantetheinyl transferase [Shewanella sp. BR-2]
  misc_feature (6)..(266): NCBI GI: 126173665 Blast Desc: 4'-phosphopantetheinyl transferase [Shewanella baltica OS155] gi|386340422|ref|YP_006036788.1| 4'-phosphopantetheinyl transferase [Shewanella baltica OS117] 4'-phosphopantetheinyl
  misc_feature (6)..(258): NCBI GI: 157962724 Blast Desc: 4'-phosphopantetheinyl transferase [Shewanella pealeana ATCC 700345] gi|157847724|gb|ABV88223.1| 4'-phosphopantetheinyl transferase [Shewanella pealeana ATCC
  misc_feature (6)..(266): NCBI GI: 160874573 Blast Desc: 4'-phosphopantetheinyl transferase [Shewanella baltica OS195] gi|378707823|ref|YP_005272717.1| 4'-phosphopantetheinyl transferase [Shewanella baltica OS678] 4'-phosphopantetheinyl
  misc_feature (119)..(182): Pfam Id: PF01648 Pfam Desc: 4'-phosphopantetheinyl transferase superfamily
MKTSVVDLWLCSLSNLDDQPDNVSQLKKRLTADEIAKVERYRMPSSQIQALYVRNYLRKVLSRYSDLMPEAWRFEYGEKGKPSLVAKQQLKTGLNFNISHSKEHLLIAVCQREGKQVQLGVDIEHARSSTNIDSIMKHYFSGKELADLLELSKEEQRERFFDLWALKESYIKATGKGLATSLRSFSFEFSNLTEQTLPIHASDFQPNLQDEIRLYREIRLDSGVGVDLDSYQQDDISTDWQCCLGRLDDQYRFAVTLGGNLLPMQIEMRTFSSSHLF

SEQ ID NO: 87 - DNA, 7869 bp, Vibrio sp.
  misc_feature: PfaA gene
  misc_feature: SGI cDNA ID NO. 1527656
  misc_feature: Encodes the peptide sequence at SEQ ID NO 88
  misc_feature: Useful for modulating production of PUFA
atgagccaacccgagacaaatacaccggaatcagtcgacgattctcgactgaataaacgccttaaagatatgcctgtcgctatcgttggtatggcgagcatgtttgcaaactctcgctacctgaataaattttgggatcttatcagcgaaaagatcgatgcgattactgaagtaccagatacgcactggcgtccagaagattactacgattcagatcgtactacgccagacaagtcttactgtaagcgcggtggtttcatcccagaagtagacttcaacccaatggagttcggccttccgccaaatatcctagaactgacagacacttcacagctgctatctctgatcgttgctaaagaagtacttgaagatgccaagctgcctgaaggctacgatcgcgataagatcggtatcacgctcggtgttggtgttggtcaaaagatcgctcaaagcctaaatgcacgtcttcaataccctgttttgaaaaaagtcttcaagagcagtggcatcaacgacgaagacagcgaaatgctgatcaaaaaattccaagaccaatacatccactgggaagagaactcattccctggttcattgggtaacgtaatttcaggtcgtatcgctaaccgctttgaccttggtggcatcaactgtgtagtagacgctgcttgtgcaggttctctagccgcaatgcgtatggctttaagtgagctggttgaaggccgcagtgaaatgatgatcacaggtggtgtgtgtactgataactcgccaaccatgtacatgagcttctctaaaactcctgcatttactaccaatgaaaccattcaacctttcgacatcgactcaaaaggcatgatgattggtgaaggtattggcatggttgctcttaagcgtcttgaagatgctgaacgcgacggcgacagaatctactcagtaattaaaggtgtcggttcttcttcggacggtaagttcaagagtatttacgcgcctcgccctgaaggacaagcaaaggcactaaagcgtgcttacgatgatgcaggtttcgcaccgcacacgcttggccttttagaagcgcacggcacaggtacagcagcaggcgatgtcgctgaatttggtggcttaaactcggtattcagtgagaacaatgaagagaagcaacacattgcgttaggctcggtgaaatctcaaattggtcacactaaatcaactgcgggtactgcaggtttaatcaaagcagcactggcactgcaccacaaagtactgccgccaacgatcaacgtatcggctccgaatcctaaactggatatcgagaattcaccgttctacctaaacacacagacgcgtccttggatgaaacgtgtcgacggcacaccgcgccgtgcaggtatcagctcattcggttttggtggcactaacttccacgttgtattggaagaatacacaccagaacacgctcgcggtgccaaataccgtcagcgccaagtaccgcaaactctgttattcagcgcagaatctcgtcaagcactgatcaatgacctcaagcagatttcaactcaagccgcagatgctgcgttcaaactagaagcgcttgctgagcagcacgctctacgcgaagttgacgctaagcacgctcgtcttggtttagttgtcaatgaccaagcagaccttcaagcgcaactgactcaagcgctttctatgcttgagagccaaaccaaagcacattggcagatgccaaacggcactagctaccgtgagtcggcactgattgctgcaaacggcgcaggtaaagtggcagcgctatttgcaggtcaaggttcgcaatacctaaacatgggtcgcgagcttgcttgtcactaccctgagatgcgccaacagattgctcaagcggatcaagtatttggtcagcacaagaaaacggctctgtcgcaaattctgttcccaattccaaccttcacaccagaagcaaccaaagctcaagaagcggtgttaaccaacacggccaatgcgcaaagtgcgattggtactgtgtccatgggtcagttcgacatcatgactcaagctggcttcaaagccgacatggtggcaggtcatagctttggtgagctaagcgcattatgtgcatcgggtgttatctcgcaagacgattactaccagctagctttcgctcgtggcgatgcaatggctgcgacaactgaacaaggcgacagcggtactatgtttgcggtcatcttagacgcagacaagcttccagccgttgaaagctgcatcagccaatttgaaggcgtgagtattgccaactacaacgctccgactcaactggttattgcaggtccaactgcgacggttcaacaagcagcacaagcgctaactgatcaaggcttcaaagcgattgctctgccagtgtctggtgctttccacacaccgcttgttgctcacgctcaaaaaccatttgctgctgcaattgataaagcttcattcagcgctccaacgctgccgctttactcaaacgcaacgggcaaactgcacagcaaagacgctaaagcaatcaagaaagcattcaaacagcacatgctgcaatcggttcgtttcagcgagcaaattgaagcgatgtatgaagcaggcgcgcgtgtattcgttgagttcggtccaaagaacattcttcaaaagctggttgaaaaaacactggctgataagaacgaagaactttacgcaatcagcatcaacccaagccctaaaggcgacagtgaccaacagcttcgtttagctgcggttcaactttgcgtagcaggtgtttcattagacaacattgacccttaccaagctgacattgctgaacctgcgaaggcatcaccaatgaacatcaagctgaatgcaaccaactacatcagccctgctactcgtaagaaaatggatcaatcattggcttcgggcaacgtcaccgaaaagactgagattgttgaagtgaaagttgaagtcgagaaaatcgtggaaaaagaagtgttcaaaacagaaatcgttgaagtacctgtggctgctcctcaagcttcaaatgtacaaccgtcaactgctccagcaccaagtgcacaagtagtaacagcagctcagcagcctcaagtagcacaacctgcaccagcaactgttcagccaacagcttcagtaacggttgatgagtcttcattgcagtcattcttcaatgctcaacaacaagcagcagaagtacatcagcagttccttgcgattcctcagcaatacggtgacacgttcaacaccctaatgtctgagcaagcgaaaatggcaacagcaggcgtagcaattcctgagaacctgcaacgttctatggaaatgttccaccagcaccaagctgaaacgctaaaagctcacgctcattacctagaaatgcaagcgcacagcaacaactcagcacttaatatgctgacgcaaggttcagcacaaacggcacaaccaaccttcgttgcgccattaaatgctcagccagcgattcaagctccaactactccagcagcaatcgtccaacagcctgtagctcaagtgcaaacagctcctgtacaagctcagtctgttcaagcagtaccagttcaaaatacaacagctcagcaagctccagtccagaaagccgtgcctgcaccacaagtagccgctcaagcagcagcaccggttgcagctcagcctgtgccagttaaagcacaaccagctcctgtggctgcaccagtagcagtacaatcagcagatgctgaaaaagtgatgctagaagtggtcgctgagaaaacaggttacccaacggagatgcttgatctagaaatggacatggaagcagaccttggtatcgactcaatcaagcgcgtagagattcttggtaccgttcaagacgaaatgccaaacctacctgagctgaaccctgaagatttagctgagtgtcgtactcttggcgaaatcgttacttacatgaacagtaaaagcatgaacagtaagatgccagcatcagcgcctgtggcagcacagccaagcgcaaccgctcctgttcaagcagctaacggtcttaatgcaaaagtcgttcaacaaaccatgctagaagtggttgctgagaagacaggttacccaacggaaatgcttgatctagaaatggatatggaagcagaccttggtatcgattcaatcaagcgtgttgagattcttggtacggttcaagatgaactgcctactcttccagagctaaatcctgaagacttagctgagtgtcgcactcttggcgagattgttgactacatgaacaacaagcttccagcttcggctcccgtgtcttcacaagcagcagtagttgctccggcaacagctagcaatggtctagatgcggctgtcgttcaaaaaaccatgttagaagtagtagcagagaagacgggctacccgactgaaatgctagacctagcaatggacatggaagctgaccttggtatcgactcaatcaaacgtgttgaaattctaggtacggttcaagacgagctaccgactcttccagagctaaaccctgaagatctcgcagagtgtcgtactctaggtgaaattgttgactacatgaacagcaagcttcctgcttctgctccagtagcggctcaagtatcagcaccagtacaagcaatatcaaacggtttaaacgcagaacaagttcaaggcacaatgctgagcgtagtagcggataaaacgggctacccaacagaaatgctagacctagcaatggacatggaagctgaccttggcatcgactcaatcaaacgtgttgagatccttggtacggttcaagaccagctaccaacattgccagagctgaatcctgaagacctagctgagtgtcgtactctgggtgaaatcgttgactacatgaacagcaagttagctcctagttcggaagcagcgacagtagctcctgctgcagaagtagaggcaattgtagaaagcgcaagcaacgacctaaacccagctcacgttcaatcaacaatgatggaagtggttgccgacaaaacaggctacccagcagaaatgctcgacctagcgatggacatggaagcagaccttggtatcgactcaatcaaacgcgttgagatcttgggtacggttcaagaccagctaccaacgctgccagagctaaaccctgaagacttagctgagtgtcggactcttggtgaaatcgttacctacatgcaaagcaagctatccgctgctgcacctgtagcgactgctaaagctgaatcagtaacgcctatcgcagaaacagcgacagcggaacttcctccacacaatgaggtagcgctaaaaaagctaccagcggcagataaactcgtcgattgtttctcaaaagacgcttgtgtcgtgatcacagatgatggtcacaacgctggtgttctagcagaaaagttgaccgctaacggcattcaagttgctgtagtgcgtagtgctctttctgccgcgtcacctttaaacagtgaaatcgcaagctacacactcaacagcgtcgatgatgctggtgtgacagctgtgattaaagacatcgaagcagaccttaaaacgtcgaacaaagtgattgctggcttcattcatttacaagctatcgttgatgcgaaacaaagcaacgagcaagcggttaacttgaatgcagactcaagagcttcactaaccacagcgttcttattcgcgaagcacctaaatggtcagctgaataccgtttctggtcgtagtgtgttcttcacgctaagccgtatcgatggtggctttggttacctagatactaagcaattagcgaatgcagaactcaaccaagccgcgttgtctggtctaactaagacactgagccatgaatggtcaaacgtgttctgccgcgcattggatgctgacgcttctattgatgctcgtcacctagctgaagctatcacaggcgaattgttcgatatcgataccaacacggttgaaatcggccttagccatgcagaaaacggtgaatctggtcgtgcaacattgattgcggcaacaccaggtgctgctcaaaccaaaaacacaggtgctcaactcaccaagagcgacaaagttctcgtgacaggtggcgctaaaggcgtaacgtttgaatgtgcactgacgcttgctaagcaatgcaaatctcacttcattcttgcaggtcgtagtaagcatattacttcagctgagctacctcagtgggcacaaggcaaacaagagaaagagctaaaaccagcggctattgctcacctacaagcaacaggtgacaaaccaacgccaaagaaagttgatgccttactaaaaccagtattgagcagccttgaaatcaacgcagcacttgccgctttcaacgagattggcgcgagcgctgaatacctaagcttagatgtatcgaaccatgagtctgtagcgaaaacactggcgaatttcgacggcatcacgggtcttatccacggtgcaggcgtactggctgacaagcacattcaagataaaacacttgatgaactgaacatggtttacggcacgaaagtaggcggactagaagcggttcttggtggtcttgatagcagcaagctaaaactgattgcgatgttctcttcggcggcgggtttctacggaaacactggccaaagtgattactcgatgtctaacgagatcctaaacaaagcggctctacaattgtctgctcgcaaccctcaagcgaaagtgatgagcttcaactggggaccgtgggacggtggcatggtcaacgcagcactgaaacgtatgttcacagagcgcggcgtgtacgtaattcctcttcaggcaggtgcagagctgtttagttctcaactactgaacgaaactggcattcaactgctggttggtacgagcatgcaaggttctgacaacaaggaagctgctgtaaaaaagcttaatgcggagtctgtgcatcttgcaaagagtccgctgaatacaagcatcactgtgacacgtcatcttgatcctaaggctttgcctttcattcaagatcactgcattgccggtaacccagtgttaccgacagtgtgtgccatccaatggatgcgtgaagtggcagagcaactgttaggggtgaacgttagcgttcacaactacaaactgcttaagggtgtgatttttgagactgatgaagtgcaagagctgaaactggttctttcttctgatgctaaatcaaaagatcagctaaaagcagtgatcagttgccaagggcgaccacagtatcaagctcagttgcaagttgcctctgtgcaagtgtctgaagatgttcaacaagcatcagaaaaacgctttgaaaccaacacttcagcacctgtaacaacggcacaagttctatacagtgacggcactctgtttcacggaccaagactgcaaggtattacctcagttgaacgctttgacgacttaggcttattggctcaatgccagttgcctcagattgaaaacagcgactgcggatcatttattcctaagcaaggttttggcgatagccagccatttgctgaagattatctgttgcaagccatgttggtgtgggctcgattgaaatacggcgcggcaagcctaccgtctgcaatcggtgagtttatttgttacgcaccgatgcacgatggtgaccaaggttggctagagctgagcgtgataaaaagcacggctcgttcgctgcaagctgatatctcgctttaccaccaagatggtcgtttaagcgcagtaatgaaaggtgcaaaagtcaccatcagcaagagcttaaacgacgcatttttgccgaagtctagctcagcagtatcgaagaaagaagcgactaagaacccagaaaaggagcaattgtcatag

SEQ ID NO: 88 - protein, 2622 aa, Vibrio sp.
  misc_feature: PfaA polypeptide
  misc_feature: SGI Peptide ID NO. 1527656
  misc_feature: Useful for modulating production of PUFA
  misc_feature (1)..(2622): NCBI GI: 84387725 Blast Desc: omega-3 polyunsaturated fatty acid synthase PfaA [Vibrio splendidus 12B01] gi|84377408|gb|EAP94275.1| omega-3 polyunsaturated fatty acid synthase PfaA [Vibrio splendidus
  misc_feature (1)..(2622): NCBI GI: 86147635 Blast Desc: omega-3 polyunsaturated fatty acid synthase PfaA [Vibrio sp. MED222] gi|85834546|gb|EAQ52695.1| omega-3 polyunsaturated fatty acid synthase PfaA [Vibrio sp. MED222]
  misc_feature (1)..(2622): NCBI GI: 218710183 Blast Desc: omega-3 polyunsaturated fatty acid synthase PfaA [Vibrio splendidus LGP32] gi|218323202|emb|CAV19379.1| PfaA, omega-3 polyunsaturated fatty acid synthase [Vibrio splendidus
  misc_feature (1)..(2622): NCBI GI: 325974042 Blast Desc: omega-3 polyunsaturated fatty acid synthase PfaA [Vibrio sp. NSP560]
  misc_feature (1)..(2622): NCBI GI: 15488031 Blast Desc: AF409100_7 omega-3 polyunsaturated fatty acid synthase PfaA [Photobacterium profundum SS9]
  misc_feature (1)..(2622): NCBI GI: 325974052 Blast Desc: omega-3 polyunsaturated fatty acid synthase PfaA [Photobacterium sp. MA665]
  misc_feature (5)..(1428): NCBI GI: 75908804 Blast Desc: beta-ketoacyl synthase [Anabaena variabilis ATCC 29413] gi|75702529|gb|ABA22205.1| Beta-ketoacyl synthase [Anabaena variabilis ATCC 29413]
  misc_feature (15)..(1428): NCBI GI: 119509816 Blast Desc: Beta-ketoacyl synthase [Nodularia spumigena CCY9414] gi|119465551|gb|EAW46444.1| Beta-ketoacyl synthase [Nodularia spumigena CCY9414]
  misc_feature (15)..(1428): NCBI GI: 186681757 Blast Desc: beta-ketoacyl synthase [Nostoc punctiforme PCC 73102] gi|186464209|gb|ACC80010.1| beta-ketoacyl synthase [Nostoc punctiforme PCC 73102]
  misc_feature (16)..(1428): NCBI GI: 298492366 Blast Desc: polyketide-type polyunsaturated fatty acid synthase PfaA ['Nostoc azollae' 0708] gi|298234284|gb|ADI65420.1| polyketide-type polyunsaturated fatty acid synthase PfaA ['Nostoc
  misc_feature (24)..(301): Pfam Id: PF00109 Pfam Desc: Beta-ketoacyl synthase, N-terminal domain
  misc_feature (309)..(426): Pfam Id: PF02801 Pfam Desc: Beta-ketoacyl synthase, C-terminal domain
  misc_feature (599)..(906): Pfam Id: PF00698 Pfam Desc: Acyl transferase domain
  misc_feature (1254)..(1320): Pfam Id: PF00550 Pfam Desc: Phosphopantetheine attachment site
  misc_feature (1360)..(1428): Pfam Id: PF00550 Pfam Desc: Phosphopantetheine attachment site
  misc_feature (1463)..(1530): Pfam Id: PF00550 Pfam Desc: Phosphopantetheine attachment site
  misc_feature (1565)..(1631): Pfam Id: PF00550 Pfam Desc: Phosphopantetheine attachment site
  misc_feature (1671)..(1736): Pfam Id: PF00550 Pfam Desc: Phosphopantetheine attachment site
  misc_feature (2031)..(2252): Pfam Id: PF08659 Pfam Desc: KR domain
  misc_feature (2116)..(2235): Pfam Id: PF00106 Pfam Desc: short chain dehydrogenase
MSQPETNTPESVDDSRLNKRLKDMPVAIVGMASMFANSRYLNKFWDLISEKIDAITEVPDTHWRPEDYYDSDRTTPDKSYCKRGGFIPEVDFNPMEFGLPPNILELTDTSQLLSLIVAKEVLEDAKLPEGYDRDKIGITLGVGVGQKIAQSLNARLQYPVLKKVFKSSGINDEDSEMLIKKFQDQYIHWEENSFPGSLGNVISGRIANRFDLGGINCVVDAACAGSLAAMRMALSELVEGRSEMMITGGVCTDNSPTMYMSFSKTPAFTTNETIQPFDIDSKGMMIGEGIGMVALKRLEDAERDGDRIYSVIKGVGSSSDGKFKSIYAPRPEGQAKALKRAYDDAGFAPHTLGLLEAHGTGTAAGDVAEFGGLNSVFSENNEEKQHIALGSVKSQIGHTKSTAGTAGLIKAALALHHKVLPPTINVSAPNPKLDIENSPFYLNTQTRPWMKRVDGTPRRAGISSFGFGGTNFHVVLEEYTPEHARGAKYRQRQVPQTLLFSAESRQALINDLKQISTQAADAAFKLEALAEQHALREVDAKHARLGLVVNDQADLQAQLTQALSMLESQTKAHWQMPNGTSYRESALIAANGAGKVAALFAGQGSQYLNMGRELACHYPEMRQQIAQADQVFGQHKKTALSQILFPIPTFTPEATKAQEAVLTNTANAQSAIGTVSMGQFDIMTQAGFKADMVAGHSFGELSALCASGVISQDDYYQLAFARGDAMAATTEQGDSGTMFAVILDADKLPAVESCISQFEGVSIANYNAPTQLVIAGPTATVQQAAQALTDQGFKAIALPVSGAFHTPLVAHAQKPFAAAIDKASFSAPTLPLYSNATGKLHSKDAKAIKKAFKQHMLQSVRFSEQIEAMYEAGARVFVEFGPKNILQKLVEKTLADKNEELYAISINPSPKGDSDQQLRLAAVQLCVAGVSLDNIDPYQADIAEPAKASPMNIKLNATNYISPATRKKMDQSLASGNVTEKTEIVEVKVEVEKIVEKEVFKTEIVEVPVAAPQASNVQPSTAPAPSAQVVTAAQQPQVAQPAPATVQPTASVTVDESSLQSFFNAQQQAAEVHQQFLAIPQQYGDTFNTLMSEQAKMATAGVAIPENLQRSMEMFHQHQAETLKAHAHYLEMQAHSNNSALNMLTQGSAQTAQPTFVAPLNAQPAIQAPTTPAAIVQQPVAQVQTAPVQAQSVQAVPVQNTTAQQAPVQKAVPAPQVAAQAAAPVAAQPVPVKAQPAPVAAPVAVQSADAEKVMLEVVAEKTGYPTEMLDLEMDMEADLGIDSIKRVEILGTVQDEMPNLPELNPEDLAECRTLGEIVTYMNSKSMNSKMPASAPVAAQPSATAPVQAANGLNAKVVQQTMLEVVAEKTGYPTEMLDLEMDMEADLGIDSIKRVEILGTVQDELPTLPELNPEDLAECRTLGEIVDYMNNKLPASAPVSSQAAVVAPATASNGLDAAVVQKTMLEVVAEKTGYPTEMLDLAMDMEADLGIDSIKRVEILGTVQDELPTLPELNPEDLAECRTLGEIVDYMNSKLPASAPVAAQVSAPVQAISNGLNAEQVQGTMLSVVADKTGYPTEMLDLAMDMEADLGIDSIKRVEILGTVQDQLPTLPELNPEDLAECRTLGEIVDYMNSKLAPSSEAATVAPAAEVEAIVESASNDLNPAHVQSTMMEVVADKTGYPAEMLDLAMDMEADLGIDSIKRVEILGTVQDQLPTLPELNPEDLAECRTLGEIVTYMQSKLSAAAPVATAKAESVTPIAETATAELPPHNEVALKKLPAADKLVDCFSKDACVVITDDGHNAGVLAEKLTANGIQVAVVRSALSAASPLNSEIASYTLNSVDDAGVTAVIKDIEADLKTSNKVIAGFIHLQAIVDAKQSNEQAVNLNADSRASLTTAFLFAKHLNGQLNTVSGRSVFFTLSRIDGGFGYLDTKQLANAELNQAALSGLTKTLSHEWSNVFCRALDADASIDARHLAEAITGELFDIDTNTVEIGLSHAENGESGRATLIAATPGAAQTKNTGAQLTKSDKVLVTGGAKGVTFECALTLAKQCKSHFILAGRSKHITSAELPQWAQGKQEKELKPAAIAHLQATGDKPTPKKVDALLKPVLSSLEINAALAAFNEIGASAEYLSLDVSNHESVAKTLANFDGITGLIHGAGVLADKHIQDKTLDELNMVYGTKVGGLEAVLGGLDSSKLKLIAMFSSAAGFYGNTGQSDYSMSNEILNKAALQLSARNPQAKVMSFNWGPWDGGMVNAALKRMFTERGVYVIPLQAGAELFSSQLLNETGIQLLVGTSMQGSDNKEAAVKKLNAESVHLAKSPLNTSITVTRHLDPKALPFIQDHCIAGNPVLPTVCAIQWMREVAEQLLGVNVSVHNYKLLKGVIFETDEVQELKLVLSSDAKSKDQLKAVISCQGRPQYQAQLQVASVQVSEDVQQASEKRFETNTSAPVTTAQVLYSDGTLFHGPRLQGITSVERFDDLGLLAQCQLPQIENSDCGSFIPKQGFGDSQPFAEDYLLQAMLVWARLKYGAASLPSAIGEFICYAPMHDGDQGWLELSVIKSTARSLQADISLYHQDGRLSAVMKGAKVTISKSLNDAFLPKSSSAVSKKEATKNPEKEQLS

SEQ ID NO: 89 - DNA, 2058 bp, Vibrio sp.
  misc_feature: PfaB gene
  misc_feature: SGI cDNA ID NO. 1527657
  misc_feature: Encodes the peptide sequence at SEQ ID NO 90
  misc_feature: Useful for modulating production of PUFA
gtgactgttccttctaataaagcgatgccattacgcatcgctcttttagctcagccagcaaatgcggctgagctttctgccgacttattcccctcgttcccagacataatgactgttgtggttgatggcaattttaatcaagcacttactcaagcgattgaggcagtcaatcaaggcagtatggttaagctttgtttggattctcactcaccatcattgttgatgttgagtgcgctgatcgctgctcagaataagattcacccacacgcgaatttagcgggctttgtcgaagctctcgatctaaataatggagatagcgttcagcttgctctagagatgtcacgccgccccgcttcagacttaagccatcaacaacaatattctgcactttctgcttcgcagcagtttgatgagttggtgaatatagttgaggcgatatcgagccgttcattgccgagctattcattaccgagcaattactggttcactgagccgaacaaagcacgtgttgctgcgttaaccttcagcgaaaaaaacaagaaatccaccagcctgatattgactcaagcaaccggtttgcaagaaccaaagccactgctatccagcgaacgtttgatgtttgtggtttctggcaatgaccaagttgaattggtttctaagttaacctcgttaagagaagagcttaaatgcattagcgattctgcggacagcgaacttgctatcgccaacttgatgcattcaaacctaagccacttccaaagcgttcagcacaatgctggcgttggtgcgaacatcgtgattcaagcggcttcaattgaggctgcaatacaagagatcactgcgctagaaaatgcgttgccaaaagtaatggctgacaatagccaatacaaaacgccagcgggcagttgtttctcaccgaagcctcaaagcaaaggtggcgttacatttgtttaccctggtgttggcacagtttatcccggtatgttgcgcgaatttcaccaccatttcccacagttatttgctcgcttagaacgcgaaggtaacttgaaagagatgctacaggctgaaaaaacctacgctgacgacgcgcaagaaatgtcgctcagtgaactggcaattgccggtgtcggcagtagttatctgttaacacaactgctatgtgatgaattcaaagtacagccagatttcgctttgggttactccaagggtgaagcctccatgtgggcgagcttaaatgtttggaaaaacccacatgcgctgattgagatgactcaaactagccctattttcacgacggctatttctggtgaactcaccgcagtgcgtcaagattggcagctgaacgacgacgaaagcatccaatggaacagctttgtggttcgcagtgatgcgcaagcgattgaggctctgttaccagagtttccgcgtgcttatctcgctatcatccaaggtgatacttgcgtgctagcaggttgtgaaagctcatgtcgtgcattgctcaagaaactgggtaaacgtggcattgccgctaaccgtgttactgcaatgcacaccacgccagcgttgagccagcatagccaagtgcaagagttttacacgcaaccactgttcgacgagttgccaaagcatatccgctttatcagcgcagcaggtctaccgactggcgcaccaatcaatatcgacagcgacagcatcgccctttcgattgccgacactttctgttcaacgctggatttcaccgcgttgatccagagtgcacgtcaacaaggtgctcgcctgtttgtagaagtcggtgccgatcgtcaaactagcacattgatcgacaagatcaatcgtagcgacaacgtagccgaccaatactgcacaatcgcttccaatgccaaaggtggtgacgatattgtcacgctcatcaagtgcattggtcagctcattactcatcaaattccattgtctgtcgagccaattattcaagggctagaacaacaggtcaccgccgctaagcaattaagtggtgtatctcaaggcagcgcagtgaatcatcaaggagagctagtatga

SEQ ID NO: 90 - protein, 685 aa, Vibrio sp.
  misc_feature: PfaB polypeptide
  misc_feature: SGI Peptide ID NO. 1527657
  misc_feature: Useful for modulating production of PUFA
  misc_feature (1)..(685): NCBI GI: 84387724 Blast Desc: omega-3 polyunsaturated fatty acid synthase PfaB [Vibrio splendidus 12B01] gi|84377407|gb|EAP94274.1| omega-3 polyunsaturated fatty acid synthase PfaB [Vibrio splendidus
  misc_feature (1)..(685): NCBI GI: 325974044 Blast Desc: omega-3 polyunsaturated fatty acid synthase PfaB [Vibrio sp. NSP560]
  misc_feature (1)..(685): NCBI GI: 86147636 Blast Desc: omega-3 polyunsaturated fatty acid synthase PfaB [Vibrio sp. MED222] gi|85834547|gb|EAQ52696.1| omega-3 polyunsaturated fatty acid synthase PfaB [Vibrio sp. MED222]
  misc_feature (1)..(685): NCBI GI: 218710184 Blast Desc: omega-3 polyunsaturated fatty acid synthase PfaB [Vibrio splendidus LGP32] gi|218323203|emb|CAV19380.1| PfaB, omega-3 polyunsaturated fatty acid synthase [Vibrio splendidus
  misc_feature (1)..(685): NCBI GI: 90413868 Blast Desc: omega-3 polyunsaturated fatty acid synthase PfaB [Photobacterium profundum 3TCK] gi|90325052|gb|EAS41562.1| omega-3 polyunsaturated fatty acid synthase PfaB [Photobacterium
  misc_feature (1)..(685): NCBI GI: 325974054 Blast Desc: omega-3 polyunsaturated fatty acid synthase PfaB [Photobacterium sp. MA665]
  misc_feature (1)..(685): NCBI GI: 15488032 Blast Desc: AF409100_8 omega-3 polyunsaturated fatty acid synthase PfaB [Photobacterium profundum SS9]
  misc_feature (9)..(685): NCBI GI: 325974034 Blast Desc: omega-3 polyunsaturated fatty acid synthase PfaB [Shewanella sp. MAR441]
  misc_feature (9)..(685): NCBI GI: 54308652 Blast Desc: omega-3 polyunsaturated fatty acid synthase PfaB [Photobacterium profundum SS9] gi|46913081|emb|CAG19870.1| omega-3 polyunsaturated fatty acid synthase PfaB [Photobacterium
  misc_feature (9)..(684): NCBI GI: 212636305 Blast Desc: Omega-3 polyunsaturated fatty acid synthase PfaB [Shewanella piezotolerans WP3] gi|212557789|gb|ACJ30243.1| Omega-3 polyunsaturated fatty acid synthase PfaB [Shewanella WP3]
  misc_feature (159)..(658): Pfam Id: PF00698 Pfam Desc: Acyl transferase domain
MTVPSNKAMPLRIALLAQPANAAELSADLFPSFPDIMTVVVDGNFNQALTQAIEAVNQGSMVKLCLDSHSPSLLMLSALIAAQNKIHPHANLAGFVEALDLNNGDSVQLALEMSRRPASDLSHQQQYSALSASQQFDELVNIVEAISSRSLPSYSLPSNYWFTEPNKARVAALTFSEKNKKSTSLILTQATGLQEPKPLLSSERLMFVVSGNDQVELVSKLTSLREELKCISDSADSELAIANLMHSNLSHFQSVQHNAGVGANIVIQAASIEAAIQEITALENALPKVMADNSQYKTPAGSCFSPKPQSKGGVTFVYPGVGTVYPGMLREFHHHFPQLFARLEREGNLKEMLQAEKTYADDAQEMSLSELAIAGVGSSYLLTQLLCDEFKVQPDFALGYSKGEASMWASLNVWKNPHALIEMTQTSPIFTTAISGELTAVRQDWQLNDDESIQWNSFVVRSDAQAIEALLPEFPRAYLAIIQGDTCVLAGCESSCRALLKKLGKRGIAANRVTAMHTTPALSQHSQVQEFYTQPLFDELPKHIRFISAAGLPTGAPINIDSDSIALSIADTFCSTLDFTALIQSARQQGARLFVEVGADRQTSTLIDKINRSDNVADQYCTIASNAKGGDDIVTLIKCIGQLITHQIPLSVEPIIQGLEQQVTAAKQLSGVSQGSAVNHQGELV

SEQ ID NO: 91 - DNA, 5949 bp, Vibrio sp.
  misc_feature: PfaC gene
  misc_feature: SGI cDNA ID NO. 1527659
  misc_feature: Encodes the peptide sequence at SEQ ID NO 92
  misc_feature: Useful for modulating production of PUFA
atgagttctcaatcgaagccatctcaagatcaagctcaggctcaagctaagaataagcagcaagtgaagtgcaataagatcgcgattgttggtattgctaaccaatacccagaagcggatacaccaaaagacttttggcaaaacttgctgaataaaaaagattctcggaccacattaagcgctgaaaagttaggtgctaagcctgaaagctatcagggtgtgcaaggtgaatcagaccgcttttactgtgacaaaggcggctacatcgaaaacttcaatttcgatagcaatggctaccgcttaacagcagaatcgttcaacggtgttgaccagagtttcctatgggctttggataccagccgtaaggcgttagtcgacgcaggcattgatctgaattccgatgttttagagcgtaccggcgtgatcatgggtgccctttcgttcccaactacacgctcaaacgacctgtttctgccgatgtatcactcggtggtcgaaaaagcactgaaagataaattagctaatgaccagttttcactgctaccaaccaatgaaaccgcgcaagacctcaaccctatcaatggtgctgcagcacataatgcctctaagttagtggctgatgcattgggtctaggcaacgtgcaacttagcctagacgcggcatgtgcaagctcagtgtattcattgaagttagcctgtgattacttgaatacgggcaaggccgacatgatgttggcaggcgcggtatccggtgctgacccattctttatcaacatgggtttttccattttccacgcttaccctgaccacggtgtgtcggttccgtttgatagcaacagtaaaggtctatttgctggcgaaggtgccggtgttttagtcctaaaacgcttagctgatgcagagcgtgatggcgacaacatttacgcagtcgtcagcggtattggcttgtcgaacgatggtcgtggtcagttcgtattaagcccaaatagcaaagggcaagtccaagcctttgaacgcgcttacgaagcatcaaacctaacaccagacagcattgaggtgattgagtgtcacgcaaccggcacaccattaggtgacaaggttgagttaacctcaatggagcgtttctttgctgacaaattgaatggttctaatccgccattgattggctctgcgaagtccaacctcggtcacttgctgactgcagccggcatgccggggatcatgaagatgatctttgcgatgaaagaaggagtgcttcctccaagtattaatttggacaagccactatcgtcgccagaaggtttatttggttcacagaccctgccaacgcaggttcaaccttggccaagtaaagcgggcaacccagagcgctgtgcgggtgtttctgtatttggtttcggtggttgtaatgctcacttactgcttgaagcgtattcagacaccagtcatgtaaaccagactctagagtcagcgtctccaagcctacagccgtctaatttaagcattactggtctcgcgtctcacttcggttctctgcaaagtatcaagacgctaagcactgcgattgagaccaacaacgatgctttcattgctttgcctaagaaacgctggaaaggcttagaccaacatctagaactactgaatcagtttggtttacatggtattccaaacggagcgtacatcgatcaattcgatctcgatttcctacgcttcaaagtgccgccgaatgaagatgaccgtttgatctctcagcagttgctactgatgaaagttgcagacgaagccatcaaagacgccaagctcgtggcaggccaaaaggttgcagtactggtagcgatggaaacagagcttgaaatgcaccaattccgtggacgcgtaaacctgcatagccaattggctgacagctttaccaacatggggattgagctaacacaagatgaataccaatcgctagaaaccatcgcgatggacagtgtgatggacgcagccaagctgaaccaatacaccagtttcattggtaacatcatggcttcgcgtatctcttcactgtgggactttaacggccctgcctttacgatttcagccgctgaacagtcggttgctcgttgtatcgatgtcgcgcaaaacctaatgtcgcaagaatcaatggacgcagtcgtgattgcagccgttgaccttagtggcagtgcagaacatgtgattctgaagaacagcgtcagcccagtgtcacttgctccaaaattcggacaaccgcaagacggtagttggaatgtgggcgaaggcgcaggtgcaattgttcttgttgaagaaagccgagtagcgcgcaaccaagacactgcttacggcagcatcaacgcattggcctttggttcaagcgagaataacaacgccgtggctgatgagttattgactcaagtcggtatgagctcgaacgatgtttctctgcttgagcttaaccatgcacctgaatcttcattacatcagtcttcgtcatatcagtcttcgtctctaagtttagcgagcacaaggacgactcaagcgagtctacgtgttgggcactgctccgcagcttctggcatggcaagcctgctacacggtctgctcaacctgaaccttgagtctctgaatccaaatgtcagctctaagaacgcgattgttgccaacatcagcgaaggacaatgttcacagctgctaataagccagtcgagtgttgaatctcaatcactatcggttcgtttaagcagtgaactggcgagtgatgctaaacgtcaattggttaagcaagtgactctcggtggtcgcgatatctatcaacatattgcccaaaccccagtgactaacttagcaacgattcaacagaaagcttctggtaaacaagcagcaagagtggcgtcggttccaacgacagcaagcattcaagcagctcttgtgcaaaaagagttagagaagaaagcattagcgcagaacgcggtagagccagcaatcgaaactcctacatcagtatcccctactctggcgccaactcgccacagtcagctaacaggtaaccacagcaatatgactcatgtcctatccgctaaaaatggcgtatcaaacatcaacgctaatacggatgcagcatcacagccgtctgtaacaccacacaaccaagcttttgctcaaaaccagcaagcagcgcagcaagtgcacaaagcattcttgcacactcgtgcccaaggcatgcagatggctgatgcactattaaaagcacagctaaacgccgttacgtctggtttagagaacaatgccatttctcaacaaacgaatggtcaacaaacatcagttcagcctgttaaagctcaaccagctcaggttcagtcaacaccagtaaaacctatccgtaagccatgtatctgggattatgatgatctggttgaatacgctgaaggcgacatcgccaacgtatttggccctgattacgcgatcatcgatagctactcgcgccgcgttcgcttgccaactaccgactacctattggtatctcgtgtaaccaagctcaacgcgaccgtcaacgagtacaagccaagcacaatgactaccgaatacgacattcctgttgatgcgccgtatcttgttgatggccagatcccttgggctgttgcggtagaatctggtcagtgtgacctaatgctgatcagctacttaggcattgattttgaaaacaaaggcgagcgtgtttatcgcctgcttgattgtacgctgaccttccttggcgacttgcctcgtggtggcgatacgctgcgttacgatatctcaatcaacaactttgctcgcaatggcgatacgttgctgttcttcttctcgtacgagtgtttcgttggcgacaagatgatcctgaaaatggacaacggttgtgcgggcttcttcactgatgaagagctagcagacggcaagggtgtgattcacactgaagatgaaatcaaggcgcgtaagctggcaactaagcaacgcttcgaccctatgctgcactgccctaaaactcagtttaaccaccaagagctgcgccacctactgactgcaaacatcgcagagtgttttggcccaactcaccaatccaatagccaccagccttctttgtgcttcagctcagagaagttcatgatgatcgaaaaggttagccgtgttgaaccacaaggtggcacatggggacttggtctgattgaaggtcacaaacagctagagcctgagcactggtacttcccttgtcacttcaaagatgactcagtaatggctggatctttgatggcagaaggttgtggtcaactactgcaattcttcatgatgcaccttggcatgcacacgcttgttcaaaatggccgtttccaaccgcttgaaaatgcccctcaacaagtacgttgccgtggtcaagttctaccacaatcggcagaactgacttaccgcatggaagtgactgagattggtctaagccctcgcccatacgcgaaagctaacatcgatattttgctcaacggcaaagtgattgttgatttccaaaacttgggtgtgatgatcaaagaagacgacgaatgtacccgttaccagccttctttagagacgactgaaacggttatcacaacacctgcgttacagaatgaagttcagcacattgctcaaacgccagcagtgaaccaacaggcttcagcgaatgcaccactcatggcgcaaattgaagacctagcaacagcgccaaataaaggtgtggttcctcttcaacacgttgaagctccggtaacgcctgattacccaaaccgcacacctgatacggttccattcacgccttatcacatgttcgaattcgcgactggtgatattgagaaatgtttcggtcctgatttctctatctaccgcggaatgattccaccacgtactccgtgtggcgacctacagctaaccactcgtgttgttgagatcgatggcaagcgtggtgacttcaaaaagccttcatcatgtatcgctgaatacgaagtgccagaaaacgcatggtactttgatgaaaacagccatcacaccttgatgccttactcggtattgatggaaatttcattgcagccaaacggcttcatctcaggctacatgggcaccactctgggcttcccaggtgaagaactgtttttccgtaacctagacggcagcggcaaaatgctgcgtaacgtcgatttacgtggcaaaacgatcaccaacgattctcgcctgctttcaaccgtaatgatgggcaccaacatcgtacagagctttagcttcgaactgagcaccgatggcgtgccgttctaccaaggtacagcggtatttggttacttcaaaggtgcagcactgaaagaccaacttggtttggacaacggtaaggtgacccacccttggcacgttgataacaaccgtacaccggatgtaaacatcaatctgttagacaaaacgacgcgttacttcaatgcacccgtttcggctactggccaagtgcaagagcactacaaattggctggcggtcgcttgaactttatcgatacggtgcagatcaccagcgatggtggtaaagacggtctgggttacctatacgctgagcgtacgattgacccaagcgattggttcttccagttccacttccatcaagatccggtaatgccaggttctctaggtgtcgaagcgatcatcgaactgatgcaaacctacgctctaaataaagatcttggtgctggcttccgcaatcctaagtttggtcaaatccaatctgaagtgaagtggaaataccgtggtcagattaaccctctgaacaaacagatgtcactggatgtacacatcactgcaatcaaagacgaagacggcaaacgcatcatcgttggcgacgcaaacctgagcaaagatggtctgcgtatttacgaagtgaaagacatcgcgatttgtatcgaagaagcataa

SEQ ID NO: 92 - protein, 1982 aa, Vibrio sp.
  misc_feature: PfaC polypeptide
  misc_feature: SGI Peptide ID NO. 1527659
  misc_feature: Useful for modulating production of PUFA
  misc_feature (1)..(1982): NCBI GI: 84387723 Blast Desc: omega-3 polyunsaturated fatty acid synthase PfaC [Vibrio splendidus 12B01] gi|84377406|gb|EAP94273.1| omega-3 polyunsaturated fatty acid synthase PfaC [Vibrio splendidus
  misc_feature (1)..(1982): NCBI GI: 86147637 Blast Desc: omega-3 polyunsaturated fatty acid synthase PfaC [Vibrio sp. MED222] gi|85834548|gb|EAQ52697.1| omega-3 polyunsaturated fatty acid synthase PfaC [Vibrio sp. MED222]
  misc_feature (1)..(1982): NCBI GI: 218710185 Blast Desc: omega-3 polyunsaturated fatty acid synthase PfaC [Vibrio splendidus LGP32] gi|218323204|emb|CAV19381.1| PfaC, omega-3 polyunsaturated fatty acid synthase [Vibrio splendidus
  misc_feature (1)..(1982): NCBI GI: 294139971 Blast Desc: pfaC gene product [Shewanella violacea DSS12] gi|293326440|dbj|BAJ01171.1| omega-3 polyunsaturated fatty acid synthase PfaC [Shewanella violacea DSS12]
  misc_feature (11)..(1982): NCBI GI: 54308651 Blast Desc: omega-3 polyunsaturated fatty acid synthase PfaC [Photobacterium profundum SS9] gi|46913080|emb|CAG19869.1| omega-3 polyunsaturated fatty acid synthase PfaC [Photobacterium
  misc_feature (16)..(1982): NCBI GI: 157376336 Blast Desc: omega-3 polyunsaturated fatty acid synthase PfaC [Shewanella sediminis HAW-EB3] gi|157318710|gb|ABV37808.1| omega-3 polyunsaturated fatty acid synthase PfaC [Shewanella
  misc_feature (16)..(1982): NCBI GI: 170725782 Blast Desc: beta-hydroxyacyl-(acyl-carrier-protein) dehydratase FabA/FabZ [Shewanella woodyi ATCC 51908] gi|169811129|gb|ACA85713.1| dehydratase FabA/FabZ [Shewanella
  misc_feature (23)..(1982): NCBI GI: 90413867 Blast Desc: omega-3 polyunsaturated fatty acid synthase PfaC [Photobacterium profundum 3TCK] gi|90325051|gb|EAS41561.1| omega-3 polyunsaturated fatty acid synthase PfaC [Photobacterium
  misc_feature (23)..(1982): NCBI GI: 325974036 Blast Desc: omega-3 polyunsaturated fatty acid synthase PfaC [Shewanella sp. MAR441]
  misc_feature (23)..(1982): NCBI GI: 15488033 Blast Desc: AF409100_9 omega-3 polyunsaturated fatty acid synthase PfaC [Photobacterium profundum SS9] gi|325974056|emb|CCA30308.1| omega-3 polyunsaturated fatty acid synthase PfaC [Photobacterium
  misc_feature (25)..(300): Pfam Id: PF00109 Pfam Desc: Beta-ketoacyl synthase, N-terminal domain
  misc_feature (308)..(426): Pfam Id: PF02801 Pfam Desc: Beta-ketoacyl synthase, C-terminal domain
  misc_feature (501)..(771): Pfam Id: PF00109 Pfam Desc: Beta-ketoacyl synthase, N-terminal domain
  misc_feature (1377)..(1510): Pfam Id: PF07977 Pfam Desc: FabA-like domain
  misc_feature (1841)..(1973): Pfam Id: PF07977 Pfam Desc: FabA-like domain
MSSQSKPSQDQAQAQAKNKQQVKCNKIAIVGIANQYPEADTPKDFWQNLLNKKDSRTTLSAEKLGAKPESYQGVQGESDRFYCDKGGYIENFNFDSNGYRLTAESFNGVDQSFLWALDTSRKALVDAGIDLNSDVLERTGVIMGALSFPTTRSNDLFLPMYHSVVEKALKDKLANDQFSLLPTNETAQDLNPINGAAAHNASKLVADALGLGNVQLSLDAACASSVYSLKLACDYLNTGKADMMLAGAVSGADPFFINMGFSIFHAYPDHGVSVPFDSNSKGLFAGEGAGVLVLKRLADAERDGDNIYAVVSGIGLSNDGRGQFVLSPNSKGQVQAFERAYEASNLTPDSIEVIECHATGTPLGDKVELTSMERFFADKLNGSNPPLIGSAKSNLGHLLTAAGMPGIMKMIFAMKEGVLPPSINLDKPLSSPEGLFGSQTLPTQVQPWPSKAGNPERCAGVSVFGFGGCNAHLLLEAYSDTSHVNQTLESASPSLQPSNLSITGLASHFGSLQSIKTLSTAIETNNDAFIALPKKRWKGLDQHLELLNQFGLHGIPNGAYIDQFDLDFLRFKVPPNEDDRLISQQLLLMKVADEAIKDAKLVAGQKVAVLVAMETELEMHQFRGRVNLHSQLADSFTNMGIELTQDEYQSLETIAMDSVMDAAKLNQYTSFIGNIMASRISSLWDFNGPAFTISAAEQSVARCIDVAQNLMSQESMDAVVIAAVDLSGSAEHVILKNSVSPVSLAPKFGQPQDGSWNVGEGAGAIVLVEESRVARNQDTAYGSINALAFGSSENNNAVADELLTQVGMSSNDVSLLELNHAPESSLHQSSSYQSSSLSLASTRTTQASLRVGHCSAASGMASLLHGLLNLNLESLNPNVSSKNAIVANISEGQCSQLLISQSSVESQSLSVRLSSELASDAKRQLVKQVTLGGRDIYQHIAQTPVTNLATIQQKASGKQAARVASVPTTASIQAALVQKELEKKALAQNAVEPAIETPTSVSPTLAPTRHSQLTGNHSNMTHVLSAKNGVSNINANTDAASQPSVTPHNQAFAQNQQAAQQVHKAFLHTRAQGMQMADALLKAQLNAVTSGLENNAISQQTNGQQTSVQPVKAQPAQVQSTPVKPIRKPCIWDYDDLVEYAEGDIANVFGPDYAIIDSYSRRVRLPTTDYLLVSRVTKLNATVNEYKPSTMTTEYDIPVDAPYLVDGQIPWAVAVESGQCDLMLISYLGIDFENKGERVYRLLDCTLTFLGDLPRGGDTLRYDISINNFARNGDTLLFFFSYECFVGDKMILKMDNGCAGFFTDEELADGKGVIHTEDEIKARKLATKQRFDPMLHCPKTQFNHQELRHLLTANIAECFGPTHQSNSHQPSLCFSSEKFMMIEKVSRVEPQGGTWGLGLIEGHKQLEPEHWYFPCHFKDDSVMAGSLMAEGCGQLLQFFMMHLGMHTLVQNGRFQPLENAPQQVRCRGQVLPQSAELTYRMEVTEIGLSPRPYAKANIDILLNGKVIVDFQNLGVMIKEDDECTRYQPSLETTETVITTPALQNEVQHIAQTPAVNQQASANAPLMAQIEDLATAPNKGVVPLQHVEAPVTPDYPNRTPDTVPFTPYHMFEFATGDIEKCFGPDFSIYRGMIPPRTPCGDLQLTTRVVEIDGKRGDFKKPSSCIAEYEVPENAWYFDENSHHTLMPYSVLMEISLQPNGFISGYMGTTLGFPGEELFFRNLDGSGKMLRNVDLRGKTITNDSRLLSTVMMGTNIVQSFSFELSTDGVPFYQGTAVFGYFKGAALKDQLGLDNGKVTHPWHVDNNRTPDVNINLLDKTTRYFNAPVSATGQVQEHYKLAGGRLNFIDTVQITSDGGKDGLGYLYAERTIDPSDWFFQFHFHQDPVMPGSLGVEAIIELMQTYALNKDLGAGFRNPKFGQIQSEVKWKYRGQINPLNKQMSLDVHITAIKDEDGKRIIVGDANLSKDGLRIYEVKDIAICIEEA

SEQ ID NO: 93 - DNA, 1638 bp, Vibrio sp.
  misc_feature: PfaD gene
  misc_feature: SGI cDNA ID NO. 1527660
  misc_feature: Encodes the peptide sequence at SEQ ID NO 94
  misc_feature: Useful for modulating production of PUFA
atgacaactcaaactacaatcaataacgaaaagctatctccgtggccttggcagatcgaagagagcacaactcgctttgataacgcagcaatgtcgacaatattgaaagacttaagccttgcttgttacgtcgtgaaccacccagaaaaaggtttaggcgtaagccaaaaatctgagattgcatcgggcgattcagcaagctcagcgaacagccaacctgttagcgcctttgctcctgctcttggtacacaaagcctaggcgacgaagattttcgccgttgtcatggcgtgaaatacgcttactatgcaggagcaatggcaaacggtatttcatctgaagagttggtgattgcgcttggtcaagctggcattctttgttcatttggcgccgcgggcttaatcccgtctcgcgttgagcaagcgatcaaccgtatccaagcagcactgccaaacggcccttatgcgtttaacctgattcatagcccaagcgaacccgcactagagcgcggcagtgtagagctgtttttgaagcacaaagtgaaaacggttgaggcttctgccttcttaggtctaacaccgcaaatcgttcactaccgtgcagctggccttagccgtgatgcacaaggtgagattcagattggaaacaaggttattgctaaggtaagccgtactgaagtcgcgagtaagttcatgcaaccagctccagctaaaatgctgcaagctctagttgatgaaggtcgaatcacagcagaacagatggaactggcgcagctggttcctatggctgatgacattaccgcagaagcagattctggtggtcacaccgataaccgtccactggttactctactgccaacgattcttgcactgaaagagcaaatccaagcacagtaccaattcaaaactccgctacgtgtcggttgtggtggtggcgtaggtacgcctgacgctgctctagcgacgtttaacatgggtgctgcttacattgttaccggttcaatcaaccaagcgtgtgttgaggctggcgcgagcgaacacacacgtaagctgctttcgacaaccgaaatggctgacgtgactatggctccggcagcagacatgttcgaaatgggcgtgaaactgcaagtggttaagcgtggtaccttgttcccaatgcgtgcaaacaaactgtacgaactttacactcgctacgattcaattgaagcgattccagtagaagagcgcctgaaacttgagaagcaagtattccgttcaacactagatgatatttgggcggggactgtggcgcactttaacgagcgcgatcctaaacagatagaacgcgctgaaggcaacccaaagcgtaaaatggcgttgatcttccgttggtacttgggtctttctagccgttggtcaaacaccggcgaacaaggtcgtgagatggattaccaagtatgggctggccctgcacttggcgcattcaacgcatgggcgaaagacagctacctagatgattaccagcagcgtaatgcagtcgacctagcaaaacacctaatgcacggcgcagcctacttggctcgtgttaacctgctgacttcgcaaggtatcaagcttgatccggaactagcacgctggaagccgacgcaaagaatggcctag

SEQ ID NO: 94 - protein, 545 aa, Vibrio sp.
  misc_feature: PfaD polypeptide
  misc_feature: SGI Peptide ID NO. 1527660
  misc_feature: Useful for modulating production of PUFA
  misc_feature (1)..(545): NCBI GI: 325974048 Blast Desc: omega-3 polyunsaturated fatty acid synthase PfaD [Vibrio sp. NSP560] gi|325974058|emb|CCA30309.1| omega-3 polyunsaturated fatty acid synthase PfaD [Photobacterium sp.
  misc_feature (1)..(545): NCBI GI: 86147638 Blast Desc: omega-3 polyunsaturated fatty acid synthase PfaD [Vibrio sp. MED222] gi|85834549|gb|EAQ52698.1| omega-3 polyunsaturated fatty acid synthase PfaD [Vibrio sp. MED222]
  misc_feature (1)..(545): NCBI GI: 218710186 Blast Desc: omega-3 polyunsaturated fatty acid synthase PfaD [Vibrio splendidus LGP32] gi|218323205|emb|CAV19382.1| PfaD, omega-3 polyunsaturated fatty acid synthase [Vibrio splendidus
  misc_feature (1)..(545): NCBI GI: 84387722 Blast Desc: omega-3 polyunsaturated fatty acid synthase PfaD [Vibrio splendidus 12B01] gi|84377405|gb|EAP94272.1| omega-3 polyunsaturated fatty acid synthase PfaD [Vibrio splendidus
  misc_feature (1)..(544): NCBI GI: 325974038 Blast Desc: omega-3 polyunsaturated fatty acid synthase PfaD [Shewanella sp. MAR441]
  misc_feature (1)..(544): NCBI GI: 90413866 Blast Desc: omega-3 polyunsaturated fatty acid synthase PfaD [Photobacterium profundum 3TCK] gi|90325050|gb|EAS41560.1| omega-3 polyunsaturated fatty acid synthase PfaD [Photobacterium
  misc_feature (1)..(544): NCBI GI: 54308650 Blast Desc: omega-3 polyunsaturated fatty acid synthase PfaD [Photobacterium profundum SS9] gi|15488034|gb|AAL01063.1|AF409100_10 omega-3 polyunsaturated
  misc_feature (1)..(544): NCBI GI: 219806610 Blast Desc: omega-3 polyunsaturated fatty acid synthase PfaD [Shewanella livingstonensis]
  misc_feature (6)..(545): NCBI GI: 212557792 Blast Desc: Polyunsaturated fatty acid synthase PfaD [Shewanella piezotolerans WP3]
  misc_feature (6)..(545): NCBI GI: 157376337 Blast Desc: 2-nitropropane dioxygenase [Shewanella sediminis HAW-EB3] gi|157318711|gb|ABV37809.1| 2-nitropropane dioxygenase, NPD [Shewanella sediminis HAW-EB3]
  misc_feature (93)..(366): Pfam Id: PF03060 Pfam Desc: Nitronate monooxygenase
MTTQTTINNEKLSPWPWQIEESTTRFDNAAMSTILKDLSLACYVVNHPEKGLGVSQKSEIASGDSASSANSQPVSAFAPALGTQSLGDEDFRRCHGVKYAYYAGAMANGISSEELVIALGQAGILCSFGAAGLIPSRVEQAINRIQAALPNGPYAFNLIHSPSEPALERGSVELFLKHKVKTVEASAFLGLTPQIVHYRAAGLSRDAQGEIQIGNKVIAKVSRTEVASKFMQPAPAKMLQALVDEGRITAEQMELAQLVPMADDITAEADSGGHTDNRPLVTLLPTILALKEQIQAQYQFKTPLRVGCGGGVGTPDAALATFNMGAAYIVTGSINQACVEAGASEHTRKLLSTTEMADVTMAPAADMFEMGVKLQVVKRGTLFPMRANKLYELYTRYDSIEAIPVEERLKLEKQVFRSTLDDIWAGTVAHFNERDPKQIERAEGNPKRKMALIFRWYLGLSSRWSNTGEQGREMDYQVWAGPALGAFNAWAKDSYLDDYQQRNAVDLAKHLMHGAAYLARVNLLTSQGIKLDPELARWKPTQRMA

SEQ ID NO: 95 - DNA, 843 bp, Vibrio sp.
  misc_feature: PfaE gene
  misc_feature: SGI cDNA ID NO. 1527687
  misc_feature: Encodes the peptide sequence at SEQ ID NO 96
  misc_feature: Useful for modulating production of PUFA
atgagcgctagagatatgggaataccgattgtggatttgtggctttgctccctgagtgatttacatgatgatatcgatagcgtgtcgtacttaaaacagaggctcacgatggatgagatagccaaagttgatcgctatcgaatgccctcatctcaggttcaagctttgtacgttcgtaactatctaagaaaggtgttgtcttgctattctgatttgaggccagaagagtggcgttttgaatatggtgagaaagggaagccaagattaattgagaaacaacaaatagaaaccggcctgaatttcaatatcagtcatagcaaagaacatttgttaatcgcagtttgccagagagaagggaagtcacttcaattaggcgtcgatatcgaacatgccagaagctcgaccaatatcgactcgatcatgaagcactatttttcagatacggaattgacggatttacttaagctcaacaaagaagaacaaagagagcgctttttcgatctgtgggcgctgaaggagtcgtatatcaaagcgacgggtaaagggctagccacatcgttgcgaagcttttcgtttgatttctccaatctgacggagcaaacactgtcacttcacgcttcggattttcagccaaacttgcaggatgaaattagattgcatggtgaaatcagcatatacagtggagttgggttggatgttactgagaaaaccgatagttctacagattggcagtgttgcttagggcggctggatgaacagtatcgctttgcggttacacttggcggaaatttgctacccatgcagatagaggtgagaaccttttcgtcgtctcacctcttttaa

SEQ ID NO: 96 - protein, 280 aa, Vibrio sp.
  misc_feature: PfaE polypeptide
  misc_feature: SGI Peptide ID NO. 1527687
  misc_feature: Useful for modulating production of PUFA
  misc_feature (6)..(280): NCBI GI: 218710182 Blast Desc: 4'-phosphopantetheinyl transferase [Vibrio splendidus LGP32] gi|218323201|emb|CAV19378.1| 4'-phosphopantetheinyl transferase [Vibrio splendidus LGP32]
  misc_feature (6)..(280): NCBI GI: 325974050 Blast Desc: omega-3 polyunsaturated fatty acid synthase PfaE [Vibrio sp. NSP560]
  misc_feature (6)..(280): NCBI GI: 84387726 Blast Desc: 4'-phosphopantetheinyl transferase family protein [Vibrio splendidus 12B01] gi|84377409|gb|EAP94276.1| 4'-phosphopantetheinyl transferase family protein [Vibrio 12B01]
  misc_feature (6)..(280): NCBI GI: 86147634 Blast Desc: 4'-phosphopantetheinyl transferase family protein [Vibrio sp. MED222] gi|85834545|gb|EAQ52694.1| 4'-phosphopantetheinyl transferase family protein [Vibrio sp.
  misc_feature (9)..(262): NCBI GI: 212636300 Blast Desc: 4'-phosphopantetheinyl transferase [Shewanella piezotolerans WP3] gi|212557784|gb|ACJ30238.1| 4'-phosphopantetheinyl transferase [Shewanella piezotolerans WP3]
  misc_feature (9)..(259): NCBI GI: 170727642 Blast Desc: 4'-phosphopantetheinyl transferase [Shewanella woodyi ATCC 51908] gi|169812989|gb|ACA87573.1| 4'-phosphopantetheinyl transferase [Shewanella woodyi ATCC 51908]
  misc_feature (11)..(261): NCBI GI: 167624919 Blast Desc: 4'-phosphopantetheinyl transferase [Shewanella halifaxensis HAW-EB4] gi|167354941|gb|ABZ77554.1| 4'-phosphopantetheinyl transferase [Shewanella halifaxensis
  misc_feature (11)..(272): NCBI GI: 206570562 Blast Desc: 4'-phosphopantetheinyl transferase [Shewanella sp. BR-2]
  misc_feature (11)..(261): NCBI GI: 157962724 Blast Desc: 4'-phosphopantetheinyl transferase [Shewanella pealeana ATCC 700345] gi|157847724|gb|ABV88223.1| 4'-phosphopantetheinyl transferase [Shewanella pealeana ATCC
  misc_feature (11)..(272): NCBI GI: 126173665 Blast Desc: 4'-phosphopantetheinyl transferase [Shewanella baltica OS155] gi|386340422|ref|YP_006036788.1| 4'-phosphopantetheinyl transferase [Shewanella baltica OS117] 4'-phosphopantetheinyl
  misc_feature (124)..(187): Pfam Id: PF01648 Pfam Desc: 4'-phosphopantetheinyl transferase superfamily
MSARDMGIPIVDLWLCSLSDLHDDIDSVSYLKQRLTMDEIAKVDRYRMPSSQVQALYVRNYLRKVLSCYSDLRPEEWRFEYGEKGKPRLIEKQQIETGLNFNISHSKEHLLIAVCQREGKSLQLGVDIEHARSSTNIDSIMKHYFSDTELTDLLKLNKEEQRERFFDLWALKESYIKATGKGLATSLRSFSFDFSNLTEQTLSLHASDFQPNLQDEIRLHGEISIYSGVGLDVTEKTDSSTDWQCCLGRLDEQYRFAVTLGGNLLPMQIEVRTFSSSHLF

SEQ ID NO: 97 - DNA, 7878 bp, Vibrio gigantis
  misc_feature: PfaA gene
  misc_feature: SGI cDNA ID NO. 1536686
  misc_feature: Encodes the peptide sequence at SEQ ID NO 98
  misc_feature: Useful for modulating production of PUFA
atgagccaacccgaaaaaaacacaccggaatcagtcgacgacactcgacttaataaacgtcttaaagacatgcctattgctatcgttggtatggcaagcatgtttgcgaactctcgttacttaaacaagttctgggatttgatcagtgaaaagatcgatgccattaccgaagtacctgatacgcactggcgtccagaagattactatgattcagatcgtactgcgccagacaaatcttactgcaagcgtggtggtttcatccctgaagtggacttcaacccaatggagttcggccttccgccaaatatcctagaactgactgatacctcacagctgctttctctgatcgtggcaaaggaagtactcgaagacgccaagctgcctgaaggttacgatcgcgacaagatcggtattacgcttggtgttggtggtggtcagaagattgctcaaagcttgaatgctcgtcttcaataccctgttttgaaaaaagtcttcaagagcagtggcatcaacgacgaagacagcgaaatgctgatcaaaaaattccaagaccaatacatccactgggaagagaactcattccctggttcattgggtaacgtaatttcaggtcgtattgctaatcgctttgaccttggtggcatcaactgtgtagtagacgctgcttgtgcaggttctctagccgcaatgcgtatggctctaagtgagctggttgaaggccgcagtgaaatgatgatcacaggtggtgtatgtactgataactcgccaaccatgtacatgagcttctctaaaacacctgcatttaccaccaatgaaaccattcaacctttcgatatcgattcaaaagggatgatgattggtgaaggcatcggcatggttgctcttaagcgtcttgaagatgctgagcgcgatggcgacagaatctactcagtgattaaaggtgtcggttcttcttcggacggtaagttcaagagtatttacgctcctcgccctgaaggacaagcaaaagcactaaaacgcgcttacgatgatgctggtttcgcaccgcacacgcttggccttttagaagcgcacggtacaggaacagcagcaggtgatgttgccgaatttggtggcttaaactcggtattcagtgagaacaacgaagagaagcaacacattgcgttaggctctgtaaaatctcaaattggtcacaccaaatcaaccgcgggtactgcaggtttaatcaaagcagcactggcactgcatcacaaagtactgccgccaacgattaacgtatcggctccgaatcctaaactagatatcgagaactctccgttctacctaaacacacaaacgcgtccttggatgaaacgtgtcgacggcacaccacgccgtgcaggtatcagctcgttcggatttggtggcacgaacttccacgttgtattagaagagtacacgccagagcacgctcgcggtgacaaataccgtcaacgccaagtgccgcaaacgctgttattcagcgcggagtctcgtcaagcattgatccatgagctaaaacaagtttcaactcaagctgccgatgctgcattcaaactggaagcgcttgctgagcaacacgctctacgcgaaattgacgctaaacatgctcgtattggcttagtcgtgactgaccaagcagaccttcaagcgcaactgactcaagcggtttctatgcttgagagccaaaccaaaacacattggcagatgccaaacggcactagctaccgtgagtcagcactgattgctgaaaacggcgcaggtaaagtagcggcgctattcgcaggtcaaggttcgcaatacctaaacatgggtcgcgagcttgcttgtcactaccctgaaatgcgccaacagcttgctcaagcggatcaagtatttggtcaacacaagaaaacggctctttcgcaaattctgttcccaattccaaccttcacaccagaagcaaccaaagctcaagaagcggtactcaccaatacggcgaatgcgcaaagtgcgattggtactgtgtctatgggtcagttcgacatcatgactcaagcgggcttcaaagcagacatggttgcaggtcatagctttggtgagctaagcgcattatgtgcatcgggtgttatctcgcaagacgattactaccagctagctttcgctcgtggcgatgcaatggctgcgacacctgaacaaggcgacagcggtactatgtttgcggtcatcctagacgcagacaagcttccagccgttgaaaactgtatcagccaattcgaaggcgtgagcattgccaactacaacgctccgactcaactggttattgcaggtccaactgcaacggttcaacaagcagcacaagcgctaactgaacaaggcttcaaagcgattgctctgccagtgtctggtgctttccacacaccgcttgttgctcacgctcaaaaaccatttgctgctgcaattgataaagcttcatttagcgctccaacgctgccgctttactcaaacgcaacgggcaaattgcacagcaaagacgcgaaagcgatcaagaaagcgttcaagcaacacatgctgcaatcggttcgtttcagcgaacaaattgaagcgatgtatgaagcaggtgctcgtgtattcgtagagttcggtccgaagaacattcttcaaaagctggttgagaaaacattggctgataagaacgaagaactttacgcaatcagcatcaacccaagccctaaaggcgacagtgaccaacaacttcgtttagctgcggttcaactgtgtgtggcaggtgtttcattagacaacattgacccttaccaagctgacattgctgaacctgcaaaggcatcaccaatgaacatcaagctgaatgcaaccaactacatcagccctgctactcgtaagaaaatggatcaatcattggcttcgggcaacgtcaccgaaaagactgagattgttgaagtgaaagttgaagtcgagaaaatcgtggaaaaagaagtgatcaaaacagaaatcgttgaagtacctgtggctgctcctcaagcttcaaatgtacaacagtcagcggctccagcaccaagtgcacaagtggcaacagcagctccacaatcacaagtggttcaaactgccccaacaactattcagccaacagctcaagtaacggtagatgagtcttcattgcagtcgttcttcaatgctcaacaacaagcagcagaagtacatcagctgttccttgcgattcctcagcaatacggtgacacattcaacaccctaatgtctgagcaagcgaaaatggcaacagcaggcgtagcaattcctgagaacctacagcgttctatggagatgttccaccagcaccaagctgaaacgctaaaagcgcatgctcattacttagaaatgcaagcgcacagcaacaactcagcacttaacatgctgacgcaaggttcagtcgaaacagcacaaccaaccttcgttgcgccagttaatgctcagccagcgactcaaactactccagcagctatcgttcaacagcctgtagctcaagtacaagcgactcctgtacaagctcagtctgttcaagctgcgccggttcaaaatacaacaactcagaaagctccagtacagaaaaccgctccggctccacaagtagcggctcaagcggcagcgcctgttgcagctcaacctgtgccagttaaagcgcaaccggctcctgtggctgcaccagtagcagtacgatcagcagatgctgaaaaagtgatgctagaagtggtcgctgagaaaacgggttacccaacggagatgcttgatctagaaatggacatggaagcagaccttggtatcgactcaatcaagcgcgtagagatccttggtaccgttcaagacgaaatgccaaacctacctgagctgaaccctgaagatttagctgagtgtcgtactcttggtgaaatcgtcggctacatgaacagtaaaagcatgaacagcaagatgccagcatcagcgcctgtggcagcacagccaagcgcaaccgctcctgttcaagcatctaatggtcttgatgcaaaagtcgttcaacaaaccatgttagaagtggtggctgagaaaaccggttacccaacggaaatgcttgatctagaaatggatatggaagcagaccttggtatcgactcaatcaagcgtgttgagattctaggtacggttcaagatgaactgcctactcttccagagctaacccctgaagacttagctgagtgtcgcactctaggtgaaattgttgcctacatgaacagcaagcttccagcgtctgcaccagttgcagcacaaaccgaagtagttgccccggtaacacctaacaacggactcgatgctgctgtcgttcagaagacgatgttagaagtggtagcagaaaagacgggctacccgactgaaatgctagacctagcaatggacatggaagctgaccttggtatcgactcaatcaaacgtgttgagattctaggtacagttcaagatgaactgcctattcttccagagctaaaccctgaagatctcgctgagtgtcgtactctaggtgaaatcgttgcttacatgaatactaaaagcatgaacagtaagcttcctgcttctgctccagtagcggctcaagtatcagcaccagtacaagcaatatcaaacggtttaaacgcagaacaagttcaaggcacaatgctgagcgtagtagcggataaaacgggctacccaacagaaatgctcgacctagcaatggacatggaagctgaccttggtatcgactcaatcaaacgtgttgaaattctaggtacagttcaagacgagctacctactcttccagagctaaaccctgaagatctcgctgagtgtcgtacactaggcgaaatcgttgcttacatgaacagcaagctaggcgctaatgaagctcctaacgcagcgcctgctccagaagtagctacggccgcagtagaaagcacgagcaacgacctgaaccctgaacatgttcaatccacaatgatggaagtggttgccgacaaaacaggctacccagcagaaatgctcgacctagcgatggacatggaagcagaccttggtatcgactcaatcaaacgcgttgagatcctaggtacagttcaagaccagctaccaacgctgccagaactgaaccctgaagacctagctgagtgtcgtacgcttggcgagatcgttacttacatgcaaagcaagctatccgctgctgcatctgtagcgaatccaaaagctgaatcagtaacgcctatcgcagaaacagcgacagcggaacttcctccacacaatgaggtagcgctaaaaaagctaccagcggcagataaactcgtcgattgtttctcaaaagacgcttgtgtcgtgatcacagatgatggtcacaacgccggtgttctagcagaaaagttgaccgctaacggtattcaagttgctgtagtgcgtagtgctctttctgccgcgtcacctttaaacagtgaaatcgcaagctacacactcaacagcgttgatgatgctggtgtgactgcggttattaacgacatcgaagtagaccttaaaacgtcgaacaaagtgattgctggcttcattcacctacaagctatcgttgatgctaaacaaagcaacgagcaagcggttaacttgaatgcagactcaagagcttcactgacgacagcgttcttattcgccaagcacctaaatggccaactgaatgccgtttctggtcgtagcgtgttcttcacactaagccgtatcgatggtggctttggttacctagatactaagcaattagcgaatgcagaacttaaccaagcggcgctgtctggtctcactaagacactaagccatgaatggtcaaacgtgttctgccgtgcattggatgctgacgcttcgattgatgctcgtcacctagctgaagctatcacaggcgaactgttcgatatcgatacccacacggttgaaatcggccttagccatgcggaaaacggtgaatctggtcgtgcaacattgattgctgcaacaccaggtgctgcacaaactaaaaacacaggcgctcaactcaccaagagagacaaagttctcgtgacgggtggcgctaaaggcgtgacgtttgaatgtgcactgacgcttgctaagcaatgtaagtctcacttcattcttgcaggtcgtagtaagcatattacttcagctgagctacctcagtgggcacaaggcaagcaagagaaagagctaaaacctgctgcaattgcacacctacaagcgacgggtgataagccaacgccgaagaaagttgatgccttgctaaaacctgtattgagcagccttgaaatcaacgcagcacttgccgctttcaacgagattggcgcgagcgctgaatacctaagcctagatgtatcgaaccatgagtcagtagcgaaaacgctggcgaatttcgaaggcatcacaggccttatccacggcgctggtgtactggctgacaaacacattcaagacaaaacacttgatgaactgaacatggtttacggcaccaaagtaggcggactagaagcggttcttggtggtcttgatagcagcaagctaaaactgattgcgatgttctcttcggcggcaggtttctacggaaacacaggccaaagtgattactcgatgtctaacgaaatcctaaacaaagctgctctgcagctgtctgcgcgtaaccctcaagcgaaagtgatgagcttcaactggggaccgtgggacggtggcatggtaaacgcagcactgaaacgtatgtttacagagcgcggcgtgtacgtgattcctcttcaggcgggtgcagagctatttagttctcaactgctgaacgaaactggcattcaattgctggttggtacgagcatgcaaggttctgacaacaaggaagctgctgtaaaaaagcttaatgcggagtctgtgcatcttgcaaagagtccgctgaatacaagcatcactgtgacacgtcatcttgatccaaaggcattgcctttcattcaagatcactgcattgccggtaaccctgtgttaccgacagtgtgcgccatccaatggatgcgtgaagtcgcagagcaactgttaggtgtgaacgttagcgttcacaactacaaactgctgaaaggtgtgatttttgataccgatgaagtgcaagagctgaaactggttctttcttctgatgctaaatcaaaagagcagctaaaagcggtgatcagttgccaagggcgaccacagtatcaagctcagttgcaagttgcctccgtgcaagtgtctgaagatgttcaacaagcgtcagtaaaacactttgaggccaacacttcagcacctgtaacaacggcacaagctctatacagtgacggcactctgtttcatggaccaagattgcaaggtattacctcagtcgaacgctttgacgacttaggtttattggctcaatgccagttgccccagattgaaaacagcgactgcggagcatttattcctaagcaaggctttggcgatagccagccatttgctgaagattatctgttgcaagccatgttggtatgggctcgattgaaatacggcgcggcgagcctaccgtctgcaatcggtgagtttatttgttacgcaccgatgcacgatggtgaccaaggttggctagagctgagcgtgataaaaagcacggctcgttcgctgcaagctgatatctcgctttaccaccaagatggccgtttaagcgcggtaatgaaaggtgcaaaagtcaccatcagtaagagcttaaacgacgcatttttgccgaagtctagctcagcagtatcgaagaaagaggcgactaagaacgcagaaaaggagcaattgtcatag

SEQ ID NO: 98 - protein, 2625 aa, Vibrio gigantis
  misc_feature: PfaA polypeptide
  misc_feature: SGI Peptide ID NO. 1536686
  misc_feature: Useful for modulating production of PUFA
  misc_feature (1)..(2625): NCBI GI: 84387725 Blast Desc: omega-3 polyunsaturated fatty acid synthase PfaA [Vibrio splendidus 12B01] gi|84377408|gb|EAP94275.1| omega-3 polyunsaturated fatty acid synthase PfaA [Vibrio splendidus
  misc_feature (1)..(2625): NCBI GI: 86147635 Blast Desc: omega-3 polyunsaturated fatty acid synthase PfaA [Vibrio sp. MED222] gi|85834546|gb|EAQ52695.1| omega-3 polyunsaturated fatty acid synthase PfaA [Vibrio sp. MED222]
  misc_feature (1)..(2625): NCBI GI: 218710183 Blast Desc: omega-3 polyunsaturated fatty acid synthase PfaA [Vibrio splendidus LGP32] gi|218323202|emb|CAV19379.1| PfaA, omega-3 polyunsaturated fatty acid synthase [Vibrio splendidus
  misc_feature (1)..(2625): NCBI GI: 325974042 Blast Desc: omega-3 polyunsaturated fatty acid synthase PfaA [Vibrio sp. NSP560]
  misc_feature (1)..(2606): NCBI GI: 15488031 Blast Desc: AF409100_7 omega-3 polyunsaturated fatty acid synthase PfaA [Photobacterium profundum SS9]
  misc_feature (1)..(2606): NCBI GI: 54308653 Blast Desc: omega-3 polyunsaturated fatty acid synthase PfaA [Photobacterium profundum SS9] gi|46913082|emb|CAG19871.1| omega-3 polyunsaturated fatty acid synthase PfaA [Photobacterium
  misc_feature (1)..(2606): NCBI GI: 325974052 Blast Desc: omega-3 polyunsaturated fatty acid synthase PfaA [Photobacterium sp. MA665]
  misc_feature (1)..(2606): NCBI GI: 325974032 Blast Desc: omega-3 polyunsaturated fatty acid synthase PfaA [Shewanella sp. MAR441]
  misc_feature (15)..(1448): NCBI GI: 186681757 Blast Desc: beta-ketoacyl synthase [Nostoc punctiforme PCC 73102] gi|186464209|gb|ACC80010.1| beta-ketoacyl synthase [Nostoc punctiforme PCC 73102]
  misc_feature (24)..(301): Pfam Id: PF00109 Pfam Desc: Beta-ketoacyl synthase, N-terminal domain
  misc_feature (26)..(1429): NCBI GI: 282895492 Blast Desc: Beta-ketoacyl synthase [Raphidiopsis brookii D9] gi|281199525|gb|EFA74388.1| Beta-ketoacyl synthase [Raphidiopsis brookii D9]
  misc_feature (309)..(426): Pfam Id: PF02801 Pfam Desc: Beta-ketoacyl synthase, C-terminal domain
  misc_feature (599)..(906): Pfam Id: PF00698 Pfam Desc: Acyl transferase domain
  misc_feature (1252)..(1318): Pfam Id: PF00550 Pfam Desc: Phosphopantetheine attachment site
  misc_feature (1358)..(1426): Pfam Id: PF00550 Pfam Desc: Phosphopantetheine attachment site
  misc_feature (1461)..(1528): Pfam Id: PF00550 Pfam Desc: Phosphopantetheine attachment site
  misc_feature (1568)..(1634): Pfam Id: PF00550 Pfam Desc: Phosphopantetheine attachment site
  misc_feature (1674)..(1739): Pfam Id: PF00550 Pfam Desc: Phosphopantetheine attachment site
  misc_feature (2034)..(2255): Pfam Id: PF08659 Pfam Desc: KR domain
  misc_feature (2119)..(2238): Pfam Id: PF00106 Pfam Desc: short chain dehydrogenase
MSQPEKNTPESVDDTRLNKRLKDMPIAIVGMASMFANSRYLNKFWDLISEKIDAITEVPDTHWRPEDYYDSDRTAPDKSYCKRGGFIPEVDFNPMEFGLPPNILELTDTSQLLSLIVAKEVLEDAKLPEGYDRDKIGITLGVGGGQKIAQSLNARLQYPVLKKVFKSSGINDEDSEMLIKKFQDQYIHWEENSFPGSLGNVISGRIANRFDLGGINCVVDAACAGSLAAMRMALSELVEGRSEMMITGGVCTDNSPTMYMSFSKTPAFTTNETIQPFDIDSKGMMIGEGIGMVALKRLEDAERDGDRIYSVIKGVGSSSDGKFKSIYAPRPEGQAKALKRAYDDAGFAPHTLGLLEAHGTGTAAGDVAEFGGLNSVFSENNEEKQHIALGSVKSQIGHTKSTAGTAGLIKAALALHHKVLPPTINVSAPNPKLDIENSPFYLNTQTRPWMKRVDGTPRRAGISSFGFGGTNFHVVLEEYTPEHARGDKYRQRQVPQTLLFSAESRQALIHELKQVSTQAADAAFKLEALAEQHALREIDAKHARIGLVVTDQADLQAQLTQAVSMLESQTKTHWQMPNGTSYRESALIAENGAGKVAALFAGQGSQYLNMGRELACHYPEMRQQLAQADQVFGQHKKTALSQILFPIPTFTPEATKAQEAVLTNTANAQSAIGTVSMGQFDIMTQAGFKADMVAGHSFGELSALCASGVISQDDYYQLAFARGDAMAATPEQGDSGTMFAVILDADKLPAVENCISQFEGVSIANYNAPTQLVIAGPTATVQQAAQALTEQGFKAIALPVSGAFHTPLVAHAQKPFAAAIDKASFSAPTLPLYSNATGKLHSKDAKAIKKAFKQHMLQSVRFSEQIEAMYEAGARVFVEFGPKNILQKLVEKTLADKNEELYAISINPSPKGDSDQQLRLAAVQLCVAGVSLDNIDPYQADIAEPAKASPMNIKLNATNYISPATRKKMDQSLASGNVTEKTEIVEVKVEVEKIVEKEVIKTEIVEVPVAAPQASNVQQSAAPAPSAQVATAAPQSQVVQTAPTTIQPTAQVTVDESSLQSFFNAQQQAAEVHQLFLAIPQQYGDTFNTLMSEQAKMATAGVAIPENLQRSMEMFHQHQAETLKAHAHYLEMQAHSNNSALNMLTQGSVETAQPTFVAPVNAQPATQTTPAAIVQQPVAQVQATPVQAQSVQAAPVQNTTTQKAPVQKTAPAPQVAAQAAAPVAAQPVPVKAQPAPVAAPVAVRSADAEKVMLEVVAEKTGYPTEMLDLEMDMEADLGIDSIKRVEILGTVQDEMPNLPELNPEDLAECRTLGEIVGYMNSKSMNSKMPASAPVAAQPSATAPVQASNGLDAKVVQQTMLEVVAEKTGYPTEMLDLEMDMEADLGIDSIKRVEILGTVQDELPTLPELTPEDLAECRTLGEIVAYMNSKLPASAPVAAQTEVVAPVTPNNGLDAAVVQKTMLEVVAEKTGYPTEMLDLAMDMEADLGIDSIKRVEILGTVQDELPILPELNPEDLAECRTLGEIVAYMNTKSMNSKLPASAPVAAQVSAPVQAISNGLNAEQVQGTMLSVVADKTGYPTEMLDLAMDMEADLGIDSIKRVEILGTVQDELPTLPELNPEDLAECRTLGEIVAYMNSKLGANEAPNAAPAPEVATAAVESTSNDLNPEHVQSTMMEVVADKTGYPAEMLDLAMDMEADLGIDSIKRVEILGTVQDQLPTLPELNPEDLAECRTLGEIVTYMQSKLSAAASVANPKAESVTPIAETATAELPPHNEVALKKLPAADKLVDCFSKDACVVITDDGHNAGVLAEKLTANGIQVAVVRSALSAASPLNSEIASYTLNSVDDAGVTAVINDIEVDLKTSNKVIAGFIHLQAIVDAKQSNEQAVNLNADSRASLTTAFLFAKHLNGQLNAVSGRSVFFTLSRIDGGFGYLDTKQLANAELNQAALSGLTKTLSHEWSNVFCRALDADASIDARHLAEAITGELFDIDTHTVEIGLSHAENGESGRATLIAATPGAAQTKNTGAQLTKRDKVLVTGGAKGVTFECALTLAKQCKSHFILAGRSKHITSAELPQWAQGKQEKELKPAAIAHLQATGDKPTPKKVDALLKPVLSSLEINAALAAFNEIGASAEYLSLDVSNHESVAKTLANFEGITGLIHGAGVLADKHIQDKTLDELNMVYGTKVGGLEAVLGGLDSSKLKLIAMFSSAAGFYGNTGQSDYSMSNEILNKAALQLSARNPQAKVMSFNWGPWDGGMVNAALKRMFTERGVYVIPLQAGAELFSSQLLNETGIQLLVGTSMQGSDNKEAAVKKLNAESVHLAKSPLNTSITVTRHLDPKALPFIQDHCIAGNPVLPTVCAIQWMREVAEQLLGVNVSVHNYKLLKGVIFDTDEVQELKLVLSSDAKSKEQLKAVISCQGRPQYQAQLQVASVQVSEDVQQASVKHFEANTSAPVTTAQALYSDGTLFHGPRLQGITSVERFDDLGLLAQCQLPQIENSDCGAFIPKQGFGDSQPFAEDYLLQAMLVWARLKYGAASLPSAIGEFICYAPMHDGDQGWLELSVIKSTARSLQADISLYHQDGRLSAVMKGAKVTISKSLNDAFLPKSSSAVSKKEATKNAEKEQLS

SEQ ID NO: 99 - DNA, 2058 bp, Vibrio gigantis
  misc_feature: PfaB gene
  misc_feature: SGI cDNA ID NO. 1536689
  misc_feature: Encodes the peptide sequence at SEQ ID NO 100
  misc_feature: Useful for modulating production of PUFA
gtgactgttcctactaataaagcgatgccattgcgcatcgctcttttagctcagccagcaaacgcggctgagctttctgccgacttattcctctcgttcccagacatgataactgttgtggttgatggcaattttaatcaagcacttagccgtgcgattgagactgtaaatcaaggcactgctgttaaactctgtttggattctcactcaccatcattgttgatgttaagtgcgctgaatgctgctcagaataagatccacccacacgcgaatttagcgggctttgccgaaactctcgatctagataatggagatagcgttgagcttgctctggatattgcacgccgccccgcgacagatttaagccatcaacagcaatactcagcactctctgcttcgcagcagtttgatgaatttctgaatatggttaatgcgatatcgagccgttcattgccgagccattcattagctaataattactggttcactgagccgaacaaagcacgtgttgcttcattgacctttaatgacgataaccaaaacgccaccagcctgatattgactcaagcgaccggtttgaacgaaccaaagccattgctatccagcgagcgtttgatgtttgtggtttctggcaatgaccaaactgaattagcttctcagctaacctcgttaagagaagagcttaaatgcattagcgattcggcggacagcgaaattgctatcgccagcttgatgcattcaaacctaagccacttccaaagcgttcagcacaatgctgatcttggcgcgaatatcgtgattcaagcggcttcaattgatgctgtaatacaagagatcactgcgctagcaaatgcgttgccaaaagtaatggctgacaatagccactacaaaactccggcaggcagttgtttctcaccgatgcctcaaagcaaaagtggcgttgcatttgtttaccctggtgttggcacggtttatcccggtatgttgcgcgagtttcaccaccatttcccacagttatttgctcgtttagaacgtgaaggtaacttgaaagagatgctgcaggccgacaaaacctacgctgaagactcgcaagaaatgtcgctcagtgagctggcaattgcaggtgtgggcagtagttatctgttaacacaactgctatgtgatgaattcaaagtacagccagatttcgctttgggttactccaagggtgaagcttcaatgtgggccagcttaaatgtttggaaaaatccacatgcactgatcgagatgactcaaatcagcccgattttcaccacggctatttctggcgaactcaccgcagtgcgtcaagattggcaactaagcagcgacgaaagcatccaatggaatagctttgtggttcgcagtgatgcgcaagcgattgagactctgttgccagagtttccacgcgcttatctcgctatcatccaaggtgatacttgcgtgctagcaggttgtgaaagcacctgtcgtgctctgctcaagaaactgggtaaacgtggcattgccgctaaccgtgttactgcaatgcacaccacaccagcgctaagtcagcataaccaagtgcgagagttttacacgcaaccactgttcgacgaattgccaaagcatatccactttatcagcgcagcaggtctaccgactggcgcaccaatcaatatcgacagcgacagcatcgccctttcgattgccgacactttctgttcgacgctggatttcaccgcgttgatccagagtgcgcgtcaacaaggtgctcgtctgtttgtcgaagtgggtgccgatcgtcaaaccagcacattgatcgacaagattaaccgcagcgacaacgtagccgaccagtactacacaatcgcttccaatgccaaaggcggtgacgatgttgtcacgctcatcaagtgcattggtcagctcattactcatcaaattccattgtctgtcgagccacttattcaagggctagaacaacagatcaccgccgctaagcgattaagcggtgtgtctcaaggcagcgcagtgaatcatcaaggagagctagtatga

SEQ ID NO: 100 - protein, 685 aa, Vibrio gigantis
  misc_feature: PfaB polypeptide
  misc_feature: SGI Peptide ID NO. 1536689
  misc_feature: Useful for modulating production of PUFA
  misc_feature (1)..(685): NCBI GI: 84387724 Blast Desc: omega-3 polyunsaturated fatty acid synthase PfaB [Vibrio splendidus 12B01] gi|84377407|gb|EAP94274.1| omega-3 polyunsaturated fatty acid synthase PfaB [Vibrio splendidus
  misc_feature (1)..(685): NCBI GI: 86147636 Blast Desc: omega-3 polyunsaturated fatty acid synthase PfaB [Vibrio sp. MED222] gi|85834547|gb|EAQ52696.1| omega-3 polyunsaturated fatty acid synthase PfaB [Vibrio sp. MED222]
  misc_feature (1)..(685): NCBI GI: 218710184 Blast Desc: omega-3 polyunsaturated fatty acid synthase PfaB [Vibrio splendidus LGP32] gi|218323203|emb|CAV19380.1| PfaB, omega-3 polyunsaturated fatty acid synthase [Vibrio splendidus
  misc_feature (1)..(685): NCBI GI: 325974044 Blast Desc: omega-3 polyunsaturated fatty acid synthase PfaB [Vibrio sp. NSP560]
  misc_feature (1)..(685): NCBI GI: 90413868 Blast Desc: omega-3 polyunsaturated fatty acid synthase PfaB [Photobacterium profundum 3TCK] gi|90325052|gb|EAS41562.1| omega-3 polyunsaturated fatty acid synthase PfaB [Photobacterium
  misc_feature (1)..(685): NCBI GI: 325974054 Blast Desc: omega-3 polyunsaturated fatty acid synthase PfaB [Photobacterium sp. MA665]
  misc_feature (1)..(685): NCBI GI: 15488032 Blast Desc: AF409100_8 omega-3 polyunsaturated fatty acid synthase PfaB [Photobacterium profundum SS9]
  misc_feature (9)..(685): NCBI GI: 325974034 Blast Desc: omega-3 polyunsaturated fatty acid synthase PfaB [Shewanella sp. MAR441]
  misc_feature (9)..(685): NCBI GI: 54308652 Blast Desc: omega-3 polyunsaturated fatty acid synthase PfaB [Photobacterium profundum SS9] gi|46913081|emb|CAG19870.1| omega-3 polyunsaturated fatty acid synthase PfaB [Photobacterium
  misc_feature (9)..(684): NCBI GI: 212636305 Blast Desc: Omega-3 polyunsaturated fatty acid synthase PfaB [Shewanella piezotolerans WP3] gi|212557789|gb|ACJ30243.1| Omega-3 polyunsaturated fatty acid synthase PfaB [Shewanella WP3]
  misc_feature (158)..(658): Pfam Id: PF00698 Pfam Desc: Acyl transferase domain
MTVPTNKAMPLRIALLAQPANAAELSADLFLSFPDMITVVVDGNFNQALSRAIETVNQGTAVKLCLDSHSPSLLMLSALNAAQNKIHPHANLAGFAETLDLDNGDSVELALDIARRPATDLSHQQQYSALSASQQFDEFLNMVNAISSRSLPSHSLANNYWFTEPNKARVASLTFNDDNQNATSLILTQATGLNEPKPLLSSERLMFVVSGNDQTELASQLTSLREELKCISDSADSEIAIASLMHSNLSHFQSVQHNADLGANIVIQAASIDAVIQEITALANALPKVMADNSHYKTPAGSCFSPMPQSKSGVAFVYPGVGTVYPGMLREFHHHFPQLFARLEREGNLKEMLQADKTYAEDSQEMSLSELAIAGVGSSYLLTQLLCDEFKVQPDFALGYSKGEASMWASLNVWKNPHALIEMTQISPIFTTAISGELTAVRQDWQLSSDESIQWNSFVVRSDAQAIETLLPEFPRAYLAIIQGDTCVLAGCESTCRALLKKLGKRGIAANRVTAMHTTPALSQHNQVREFYTQPLFDELPKHIHFISAAGLPTGAPINIDSDSIALSIADTFCSTLDFTALIQSARQQGARLFVEVGADRQTSTLIDKINRSDNVADQYYTIASNAKGGDDVVTLIKCIGQLITHQIPLSVEPLIQGLEQQITAAKRLSGVSQGSAVNHQGELV

SEQ ID NO: 101 - DNA, 5967 bp, Vibrio gigantis
  misc_feature: PfaC gene
  misc_feature: SGI cDNA ID NO. 1536691
  misc_feature: Encodes the peptide sequence at SEQ ID NO 102
  misc_feature: Useful for modulating production of PUFA
atgagttctcaatcgaaaccatctcaatataaatatcaggctcaagctcaggctcaaagtaagaataaacagcaagtgaagtgcaataagatcgcgattgtcggtatcgctaaccaatacccagaagctgatacgccaaaagatttttggcaaaacttgctagataaaaaagattctcgaaccacattaagcgctgaaaagttaggcgctaaacctgaaagctatcagggcatgcaaggtgagtcagaccgcttctactgtgaaaaaggcggctacatcgaaaacttcaatttcgatagcaatggctaccgcttaaccgccgagtcattcaaaggtgtcgaccagagtttcctttgggcgttggataccagtcgtaaggcgttagtcgacgctggtatcgatcttaatgccgatgttttagaacgcacaggcgtgatcatgggtgccctttcgttcccaactacacgttcgaacgatctgtttctgccgatgtatcactcggtggtcgagaaagcacttaaagataaattggctaatgatcagttttcactgctaccaactaatgaaaccgcgcaaaacctcaaccctatcaatggtgcagctgcacataacgcctctaagttagtggctgatgcattgggtctaggcaacgtgcaacttagcctagatgcggcatgtgcaagttcagtatattcattgaagttagcgtgtgattacttgaacacaggcaaagccgacatgatgttggcaggcgcggtatccggtgctgacccattctttatcaacatgggtttctccatcttccatgcttacccagatcatggtgtctccgctccgtttgatagcaacagtaaaggtctatttgctggcgaaggtgccggtgttttagtgctaaaacgtttggctgatgcagagcgtgatggcgacaatatttatgcagtcgtcagcggtattggcttatcgaacgatggtcgcggtcagttcgtattaagcccaaacagcaaaggacaagtccaagcctttgaacgcgcttacgaggcttcgaacttatcaccagacagcatcgaagtgattgagtgtcacgcaactggcacaccattaggtgacaaggttgagttaacctcaatggagcaattctttgctgacaagttgaatggttctaacccgccattgattggctctgcgaagtccaacctcggtcacttactgactgcagccggcatgccggggatcatgaagatgatctttgcgatgagagaaggcgtgctgccaccaagtattaatttggacaagccactatcgtcgccagaaggtttatttggctcacagaccctaccaacacaagtgcaaccttggccaagtaaagcgggtaactcagagcgctgcgcaggtgtgtctgtatttggtttcggtggttgtaacgctcacttactacttgaagcatattcagacaaaagtcatgcaaatcagactctagagtcagcgtctccaagcctgcagccatctagtttaagcattactggtctagcgtctcacttcggttctctgcaaagcatcaatgcgctaagcactgcgattgaaaccaacaacgatgctttcattgctttgcctaagaaacgctggaaaggcttagaccaacatccggaactactgaatcagtttggtttacatggtattccaaacggagcgtacatcgatcaattcgatctcgatttcctacgcttcaaagtgccgcctaatgaagatgaccgtttgatctctcagcagttgctactgatgaaagttgcagacgaagccatcaaagacgccaagcttgtagcaggccagaaggttgcagtactggtagcgatggaaacagagcttgagatgcaccaattccgtggacgcgtaaacctgcatagccaattggctgacagctttgccaacatgggtattgagctaacacaagatgaatatcaatcgctagaaaccatcgcgatggacagtgtgatggacgcagccaagctgaaccaatacaccagttttatcggcaacatcatggcttcgcgtatctcttcattgtgggactttaacggccctgcctttacgatctcagccgctgaacagtcggttgctcgttgtatcgacgtcgcgcaaaacctaatgtcgcaagaatccatggatgcagtcgtgattgcagccgttgaccttagtggcagtgcagagcatgtgattctgaagaacagcgtcagcccagtgtcgcttgctccaaaattcggacaaccgcaagacggcagttggaatgtcggcgaaggcgcaggtgcaatcgttcttgttgaagaaagccgagtagcgcgcaaccaagacatggcttacggcagcatcaacgcattggcctttggttcaagcgagcgtaacaacgccgttactgatgaattactgactcaagtcggtatgagctcgaacgatgtttctctgcttgagcttaaccatgcatcagagtctttgtcacataaatcttcgcttatcagcctagggaacacaaagacgacgcaggcaagtcaacgtgtgggtcattgctctgctgcttctggcatggcaagcctgctacacggtctgctcaatctgaaccttgagtctctgaatccaaatgtcagctctaagagcgcgattgttgccaacatcagcgaaggacaatgctcacagctgctactaagccaatcgagtgttgaatctcaatcactatcggttcgtttaagcagtgaactggcgagtgatgctaaacgtcaattggttaagcaagtgactcttggtggccgcgatatttatcaacatattgcccaaaccccagtgactaacttggcaacaattcaacacaaagcttctggtaaacaagcagcaagagtcgcgtcgattccaacgacagcaagcattcaagcagcccttgcgcaaaaagagttagagaagaaagcacgaacgcagaacgcggtagagccagtaatcgaaactcctacatcagtatcccctactctggcgccaactcgccacagtcagctaacaggtaaccacagcaatatgactcatgtcctatccgctaaaaatggcgagtctcaaatcgacgcagcttcacagcagccacaaaatctaagccaaaaccaagcttttgctcaaaaccagcaagcggctcaacaggtacacaaagcattcctgcacactcgtgcccaaggcatgcaaatggctgatgcactattaaaagcgcagctaaacgccgttacgtctggtttagatagctctagtttagagaacaatgcccttattcaacaaacgaatggtccacaaacgcctgttcaagctcaaccggctcaggctcattcagcgccagtaaacgcacttgcgacgccagcaccagtaaaacctatccgtaagccttgtatctgggattatgatgatctggttgagtacgcggaaggtgatattgcgaatgtgtttggccctgactacgcgatcatcgatagctacgcgcgccgcgttcgtttgccaaccactgactacctattggtatctcgtgtcactaagctcaatgcgacagtgaacgaatataaaccaagcaccatgaccaccgaatacgacatccctgttgatgcgccgtatcttgtagatggtcagatcccttgggctgttgcggttgaatctggtcagtgtgacctaatgctgatcagctacttaggcattgattttgaaaacaaaggcgaacgtgtttatcgcctgcttgattgtacgctgaccttccttggcgacttgcctcgtggtggcgatacgctgcgttacgatatctcaatcaacaactttgctcgtaatggcgacacgttgctgttcttcttctcgtacgagtgtttcgttggcgacaagatgatcctgaaaatggataacggttgtgcaggtttcttcactgatgaagagctagcagacggcaaaggtgtgattcaaactgaagatgaaatcaaggcgcgtaagctggcaactaagcaacgcttcgacccaatgttacactgcccaaaaacccagtttaaccaccaagaactgcgccacctactgactgccaacatcgcagaatgttttggcccgactcaccaatctgatcgccaccagccttctctatgcttcagctcagagaagttcatgatgatcgaaaaggtcagccgtgttgaaccgcaaggtggcacatggggacttggtctgattgaaggtcacaaacagcttgagcctgagcactggtacttcccttgtcacttcaaagatgattcagtaatggctggatctttgatggcagagggttgtggtcaactgctgcaattcttcatgatgcaccttggcatgcacacacttgttcaaaatggtcgtttccaaccgcttgaaaatgcgcctcaacaagtacgctgtcgtggtcaagttctcccgcaatcggcagaactgacttaccgcatggaagtgaccgagattggtctaagccctcgtccatacgcgaaagccaacatcgatattttgctgaacggcaaagtgattgttgatttccaaaacttgggtgtgatgatcaaagaagatgacgaatgtactcgttacctgccttctttagaaacagctgtcgcgacccctgttatcgaaagcttgggccatacaccagcagtgaatcaacaggcttcagcaaatgcgccgttgatggcgcaaattgaagatctagaaactgcgccaaataaaggtgtggttcctcttcaacacgttgaagctccggtaacgcctgattacccgaaccgcacacccgatacagttccattcacgccatatcatatgtttgagttcgcaactggcgatatcgaaaagtgtttcggtcctgatttctctatctaccgtggcatgatcccaccacgtactccgtgtggcgacctacagctaactactcgtgttgttgagatcgacggtaagcgtggagacttcaagaagccttcatcgtgtatcgcagagtacgaagtgccagaaaatgcatggtactttgatgaaaacagccaccataccttgatgccttattcggtgttgatggagatttcactgcagccaaacggcttcatctcaggctacatgggcaccacgcttggcttcccaggtgaagaactgtttttccgtaacttagatggtagcggcaaaatgctgcgtaacgtcgacttgcgtggcaaaacgatcaccaacgattctcgtctgctttcaaccgtaatgatgggcaccaacatcgtacagagcttcagcttcgaactgagcacagacggcgtgccgttctacgaaggtacagcggtatttggttacttcaaaggtgctgcactgaaagaccaactaggtttagacaacggtaaggtaactcacccttggcacgttgataacaaccgcacgccagacgtaaacatcaacctgttagacaaaacgacgcgttacttcaatgcacctatttctgctacgggagaagtgcaagagcactaccaactggctggcggccgcttgaactttatcgataccgtgcagatcaccagcgacggtggtaaagacggccttggttacctatacgctgagcgcacgattgacccaagcgattggttcttccagttccacttccatcaagatccagtaatgccaggttctctaggtgttgaagcgatcatcgagctgatgcaaacctatgcactaaacaaagatcttggcgcaggcttccgtaatccgaaattcggccaaatccaatctgaagtgaaatggaaatatcgtggtcagattaaccctctgaacaaacagatgtctctggatgtacacatcactgcgattaaagacgaagacggcaaacgcatcatcgttggcgacgcaaacctgagcaaagatggtctgcgtatttacgaagtgaaagacatcgcaatttgtatcgaagaagcccaagctagcgataaagcataa

SEQ ID NO: 102 - protein, 1988 aa, Vibrio gigantis
  misc_feature: PfaC polypeptide
  misc_feature: SGI Peptide ID NO. 1536691
  misc_feature: Useful for modulating production of PUFA
  misc_feature (1)..(1982): NCBI GI: 84387723 Blast Desc: omega-3 polyunsaturated fatty acid synthase PfaC [Vibrio splendidus 12B01] gi|84377406|gb|EAP94273.1| omega-3 polyunsaturated fatty acid synthase PfaC [Vibrio splendidus
  misc_feature (1)..(1982): NCBI GI: 86147637 Blast Desc: omega-3 polyunsaturated fatty acid synthase PfaC [Vibrio sp. MED222] gi|85834548|gb|EAQ52697.1| omega-3 polyunsaturated fatty acid synthase PfaC [Vibrio sp. MED222]
  misc_feature (1)..(1982): NCBI GI: 218710185 Blast Desc: omega-3 polyunsaturated fatty acid synthase PfaC [Vibrio splendidus LGP32] gi|218323204|emb|CAV19381.1| PfaC, omega-3 polyunsaturated fatty acid synthase [Vibrio splendidus
  misc_feature (12)..(1982): NCBI GI: 54308651 Blast Desc: omega-3 polyunsaturated fatty acid synthase PfaC [Photobacterium profundum SS9] gi|46913080|emb|CAG19869.1| omega-3 polyunsaturated fatty acid synthase PfaC [Photobacterium
  misc_feature (20)..(1982): NCBI GI: 90413867 Blast Desc: omega-3 polyunsaturated fatty acid synthase PfaC [Photobacterium profundum 3TCK] gi|90325051|gb|EAS41561.1| omega-3 polyunsaturated fatty acid synthase PfaC [Photobacterium
  misc_feature (20)..(1982): NCBI GI: 325974036 Blast Desc: omega-3 polyunsaturated fatty acid synthase PfaC [Shewanella sp. MAR441]
  misc_feature (20)..(1982): NCBI GI: 15488033 Blast Desc: AF409100_9 omega-3 polyunsaturated fatty acid synthase PfaC [Photobacterium profundum SS9] gi|325974056|emb|CCA30308.1| omega-3 polyunsaturated fatty acid synthase PfaC [Photobacterium
  misc_feature (20)..(1982): NCBI GI: 170725782 Blast Desc: beta-hydroxyacyl-(acyl-carrier-protein) dehydratase FabA/FabZ [Shewanella woodyi ATCC 51908] gi|169811129|gb|ACA85713.1| dehydratase FabA/FabZ [Shewanella
  misc_feature (20)..(1982): NCBI GI: 157376336 Blast Desc: omega-3 polyunsaturated fatty acid synthase PfaC [Shewanella sediminis HAW-EB3] gi|157318710|gb|ABV37808.1| omega-3 polyunsaturated fatty acid synthase PfaC [Shewanella
  misc_feature (21)..(1982): NCBI GI: 294139971 Blast Desc: pfaC gene product [Shewanella violacea DSS12] gi|293326440|dbj|BAJ01171.1| omega-3 polyunsaturated fatty acid synthase PfaC [Shewanella violacea DSS12]
  misc_feature (29)..(304): Pfam Id: PF00109 Pfam Desc: Beta-ketoacyl synthase, N-terminal domain
  misc_feature (312)..(430): Pfam Id: PF02801 Pfam Desc: Beta-ketoacyl synthase, C-terminal domain
  misc_feature (505)..(775): Pfam Id: PF00109 Pfam Desc: Beta-ketoacyl synthase, N-terminal domain
  misc_feature (1384)..(1517): Pfam Id: PF07977 Pfam Desc: FabA-like domain
  misc_feature (1841)..(1973): Pfam Id: PF07977 Pfam Desc: FabA-like domain
MSSQSKPSQYKYQAQAQAQSKNKQQVKCNKIAIVGIANQYPEADTPKDFWQNLLDKKDSRTTLSAEKLGAKPESYQGMQGESDRFYCEKGGYIENFNFDSNGYRLTAESFKGVDQSFLWALDTSRKALVDAGIDLNADVLERTGVIMGALSFPTTRSNDLFLPMYHSVVEKALKDKLANDQFSLLPTNETAQNLNPINGAAAHNASKLVADALGLGNVQLSLDAACASSVYSLKLACDYLNTGKADMMLAGAVSGADPFFINMGFSIFHAYPDHGVSAPFDSNSKGLFAGEGAGVLVLKRLADAERDGDNIYAVVSGIGLSNDGRGQFVLSPNSKGQVQAFERAYEASNLSPDSIEVIECHATGTPLGDKVELTSMEQFFADKLNGSNPPLIGSAKSNLGHLLTAAGMPGIMKMIFAMREGVLPPSINLDKPLSSPEGLFGSQTLPTQVQPWPSKAGNSERCAGVSVFGFGGCNAHLLLEAYSDKSHANQTLESASPSLQPSSLSITGLASHFGSLQSINALSTAIETNNDAFIALPKKRWKGLDQHPELLNQFGLHGIPNGAYIDQFDLDFLRFKVPPNEDDRLISQQLLLMKVADEAIKDAKLVAGQKVAVLVAMETELEMHQFRGRVNLHSQLADSFANMGIELTQDEYQSLETIAMDSVMDAAKLNQYTSFIGNIMASRISSLWDFNGPAFTISAAEQSVARCIDVAQNLMSQESMDAVVIAAVDLSGSAEHVILKNSVSPVSLAPKFGQPQDGSWNVGEGAGAIVLVEESRVARNQDMAYGSINALAFGSSERNNAVTDELLTQVGMSSNDVSLLELNHASESLSHKSSLISLGNTKTTQASQRVGHCSAASGMASLLHGLLNLNLESLNPNVSSKSAIVANISEGQCSQLLLSQSSVESQSLSVRLSSELASDAKRQLVKQVTLGGRDIYQHIAQTPVTNLATIQHKASGKQAARVASIPTTASIQAALAQKELEKKARTQNAVEPVIETPTSVSPTLAPTRHSQLTGNHSNMTHVLSAKNGESQIDAASQQPQNLSQNQAFAQNQQAAQQVHKAFLHTRAQGMQMADALLKAQLNAVTSGLDSSSLENNALIQQTNGPQTPVQAQPAQAHSAPVNALATPAPVKPIRKPCIWDYDDLVEYAEGDIANVFGPDYAIIDSYARRVRLPTTDYLLVSRVTKLNATVNEYKPSTMTTEYDIPVDAPYLVDGQIPWAVAVESGQCDLMLISYLGIDFENKGERVYRLLDCTLTFLGDLPRGGDTLRYDISINNFARNGDTLLFFFSYECFVGDKMILKMDNGCAGFFTDEELADGKGVIQTEDEIKARKLATKQRFDPMLHCPKTQFNHQELRHLLTANIAECFGPTHQSDRHQPSLCFSSEKFMMIEKVSRVEPQGGTWGLGLIEGHKQLEPEHWYFPCHFKDDSVMAGSLMAEGCGQLLQFFMMHLGMHTLVQNGRFQPLENAPQQVRCRGQVLPQSAELTYRMEVTEIGLSPRPYAKANIDILLNGKVIVDFQNLGVMIKEDDECTRYLPSLETAVATPVIESLGHTPAVNQQASANAPLMAQIEDLETAPNKGVVPLQHVEAPVTPDYPNRTPDTVPFTPYHMFEFATGDIEKCFGPDFSIYRGMIPPRTPCGDLQLTTRVVEIDGKRGDFKKPSSCIAEYEVPENAWYFDENSHHTLMPYSVLMEISLQPNGFISGYMGTTLGFPGEELFFRNLDGSGKMLRNVDLRGKTITNDSRLLSTVMMGTNIVQSFSFELSTDGVPFYEGTAVFGYFKGAALKDQLGLDNGKVTHPWHVDNNRTPDVNINLLDKTTRYFNAPISATGEVQEHYQLAGGRLNFIDTVQITSDGGKDGLGYLYAERTIDPSDWFFQFHFHQDPVMPGSLGVEAIIELMQTYALNKDLGAGFRNPKFGQIQSEVKWKYRGQINPLNKQMSLDVHITAIKDEDGKRIIVGDANLSKDGLRIYEVKDIAICIEEAQASDKA

SEQ ID NO: 103 - DNA, 1638 bp, Vibrio gigantis
  misc_feature: PfaD gene
  misc_feature: SGI cDNA ID NO. 1536693
  misc_feature: Encodes the peptide sequence at SEQ ID NO 104
  misc_feature: Useful for modulating production of PUFA
atgacaactcaaaccactatcaataacgaaaagctatctccgtggccttggcagattgaagggagcactacccatttcgataacgcagcaatgtcgacaattttgaaagatttaagccttgcttgttacgtagtgaaccacccagaaaaaggcttaggcgtaagccaacaagcagagattgcatcaggcgattcagcaagctcggcgcgcagccaacctgttagcgcctttgctccagctcttggtacacaaagcctaggcgacgaagattttcgtcgctgccacggcgtgaaatacgcttactacgcgggcgcaatggcaaacggcatctcatctgaagagttggtgattgcgcttggccaagctggcattctttgttcatttggcgcggcgggcttaatcccgtctcgcgttgagcaagcgatcaagcgtattcaagcagcgctgccaaatggtccttacgcgtttaacctgattcacagcccaagcgaacccgctctagagcgcggcagcgtagagctgtttttgaagcacaaagtgaaaacagttgaagcttcagcattcttaggtttaacaccgcaaatcgttcactaccgtgctgcgggtcttagccgcgatgcacaaggtgagattcagatcggcaacaaggtaatcgccaaagtaagtcgtactgaagtcgcaagtaagttcatgcaaccagctccagctaaaatgctgcaagctctagttgatgaaggccgaatcacagcagagcagatggaactggcacagctggttcctatggctgatgacattaccgcagaagccgattctggtggtcacaccgataatcgtccgctagtaaccctactgccaacgattcttgcactaaaagagcaaatccaagctcagtaccaattcaaaactccgctacgtgtcggttgtggcggcggcgtaggtacgcctgacgcagcgctagcgacgtttaacatgggcgctgcttacattgttacaggttcaatcaaccaagcgtgtgttgaggctggcgcgagcgaacacacacgtaaactgctttcgacaaccgaaatggctgatgtgacgatggctccggcggcagacatgttcgaaatgggcgtgaaactgcaagtggttaagcgcggcactttattcccaatgcgtgcgaacaaactgtatgagctgtacacacgttacgactcgattgaagcaattccagtagaagaacgcctgaagcttgagaagcaagtattccgttcaacactggatgacatttgggctggcaccgtggctcactttaacgagcgcgaccctaaacagatcgaacgagctgaaggcaacccgaagcgtaaaatggcgttgatcttccgttggtacttagggctttcaagccgttggtcaaacaccggcgaacaaggtcgtgaaatggattaccaagtatgggctggccctgcacttggcgcattcaacgcatgggcaaaagacagctacctagatgattaccaacagcgtaatgcggtcgaccttgctaagcacctgatgcacggtgcggcttacttagcacgtgttaacctgctgacttcgcaaggtatcaagcttgacccagaactagcacgctggaagccgacgcaaagaatggcgtag

SEQ ID NO: 104 - protein, 545 aa, Vibrio gigantis
  misc_feature: PfaD polypeptide
  misc_feature: SGI Peptide ID NO. 1536693
  misc_feature: Useful for modulating production of PUFA
  misc_feature (1)..(545): NCBI GI: 86147638 Blast Desc: omega-3 polyunsaturated fatty acid synthase PfaD [Vibrio sp. MED222] gi|85834549|gb|EAQ52698.1| omega-3 polyunsaturated fatty acid synthase PfaD [Vibrio sp. MED222]
  misc_feature (1)..(545): NCBI GI: 325974048 Blast Desc: omega-3 polyunsaturated fatty acid synthase PfaD [Vibrio sp. NSP560] gi|325974058|emb|CCA30309.1| omega-3 polyunsaturated fatty acid synthase PfaD [Photobacterium sp.
  misc_feature (1)..(545): NCBI GI: 218710186 Blast Desc: omega-3 polyunsaturated fatty acid synthase PfaD [Vibrio splendidus LGP32] gi|218323205|emb|CAV19382.1| PfaD, omega-3 polyunsaturated fatty acid synthase [Vibrio splendidus
  misc_feature (1)..(545): NCBI GI: 84387722 Blast Desc: omega-3 polyunsaturated fatty acid synthase PfaD [Vibrio splendidus 12B01] gi|84377405|gb|EAP94272.1| omega-3 polyunsaturated fatty acid synthase PfaD [Vibrio splendidus
  misc_feature (1)..(544): NCBI GI: 325974038 Blast Desc: omega-3 polyunsaturated fatty acid synthase PfaD [Shewanella sp. MAR441]
  misc_feature (1)..(544): NCBI GI: 90413866 Blast Desc: omega-3 polyunsaturated fatty acid synthase PfaD [Photobacterium profundum 3TCK] gi|90325050|gb|EAS41560.1| omega-3 polyunsaturated fatty acid synthase PfaD [Photobacterium
  misc_feature (1)..(544): NCBI GI: 54308650 Blast Desc: omega-3 polyunsaturated fatty acid synthase PfaD [Photobacterium profundum SS9] gi|15488034|gb|AAL01063.1|AF409100_10 omega-3 polyunsaturated
  misc_feature (1)..(544): NCBI GI: 219806610 Blast Desc: omega-3 polyunsaturated fatty acid synthase PfaD [Shewanella livingstonensis]
  misc_feature (6)..(545): NCBI GI: 212557792 Blast Desc: Polyunsaturated fatty acid synthase PfaD [Shewanella piezotolerans WP3]
  misc_feature (6)..(545): NCBI GI: 157376337 Blast Desc: 2-nitropropane dioxygenase [Shewanella sediminis HAW-EB3] gi|157318711|gb|ABV37809.1| 2-nitropropane dioxygenase, NPD [Shewanella sediminis HAW-EB3]
  misc_feature (93)..(366): Pfam Id: PF03060 Pfam Desc: Nitronate monooxygenase
MTTQTTINNEKLSPWPWQIEGSTTHFDNAAMSTILKDLSLACYVVNHPEKGLGVSQQAEIASGDSASSARSQPVSAFAPALGTQSLGDEDFRRCHGVKYAYYAGAMANGISSEELVIALGQAGILCSFGAAGLIPSRVEQAIKRIQAALPNGPYAFNLIHSPSEPALERGSVELFLKHKVKTVEASAFLGLTPQIVHYRAAGLSRDAQGEIQIGNKVIAKVSRTEVASKFMQPAPAKMLQALVDEGRITAEQMELAQLVPMADDITAEADSGGHTDNRPLVTLLPTILALKEQIQAQYQFKTPLRVGCGGGVGTPDAALATFNMGAAYIVTGSINQACVEAGASEHTRKLLSTTEMADVTMAPAADMFEMGVKLQVVKRGTLFPMRANKLYELYTRYDSIEAIPVEERLKLEKQVFRSTLDDIWAGTVAHFNERDPKQIERAEGNPKRKMALIFRWYLGLSSRWSNTGEQGREMDYQVWAGPALGAFNAWAKDSYLDDYQQRNAVDLAKHLMHGAAYLARVNLLTSQGIKLDPELARWKPTQRMA

SEQ ID NO: 105 - DNA, 828 bp, Vibrio gigantis
  misc_feature: PfaE gene
  misc_feature: SGI cDNA ID NO. 1536818
  misc_feature: Encodes the peptide sequence at SEQ ID NO 106
  misc_feature: Useful for modulating production of PUFA
atgagtgctagaaagacggaaacgttagtcattgatttgtggctttgttctttaagtgatttggatgaagatactgatcatgtgtcgcgcctaaaacagaaacttactgccgatgaagtagccaaagttgagcgctatcgaatgccttcatctcaggctcaagctctgtatgtgcgaagctgtttgagagcgatcctatctcgttactcttgtttgcagcctgaagagtggcgctttgaatatggtgaaaaaggcaaaccaagcttagttgagaagcaacagatagaaactggcctgaattttaatatcagtcatagcaaagaacatttgttaatcgcggtatgccaaacaaaagggcaaccactacagcttggggtggatattgaacatgcaagaagctcgaccaacatagcggcgatcatgaagcattacttttcggagtttgagattaacgacttactcgaactggatgacgtatctcaaagagaacgcttttttgatttgtgggcactaaaagagtcgtacatcaaagcgacgggtaaggggttggccacatcgttgaaaagcttttcgtttgatttctctaatctgacagaacaaacactgccagtttattcgttggattttcagacagagttatatggcgaaattattgtacataacggggttgggttggatgttactgaacaaggcgatgtttctgctgactggcaatgtagtttaggacggctggatgaccagttccgatttgccgtgacgcttggcggtgcaacgcttccggtgcaattagatatgaaatgcttcccagtagcaaagctacttggctga

SEQ ID NO: 106 - protein, 275 aa, Vibrio gigantis
  misc_feature: PfaE polypeptide
  misc_feature: SGI Peptide ID NO. 1536818
  misc_feature: Useful for modulating production of PUFA
  misc_feature (1)..(275): NCBI GI: 152999953 Blast Desc: 4'-phosphopantetheinyl transferase [Shewanella baltica OS185] gi|151364571|gb|ABS07571.1| 4'-phosphopantetheinyl transferase [Shewanella baltica OS185]
  misc_feature (7)..(274): NCBI GI: 84387726 Blast Desc: 4'-phosphopantetheinyl transferase family protein [Vibrio splendidus 12B01] gi|84377409|gb|EAP94276.1| 4'-phosphopantetheinyl transferase family protein [Vibrio 12B01]
  misc_feature (7)..(274): NCBI GI: 325974050 Blast Desc: omega-3 polyunsaturated fatty acid synthase PfaE [Vibrio sp. NSP560]
  misc_feature (7)..(274): NCBI GI: 86147634 Blast Desc: 4'-phosphopantetheinyl transferase family protein [Vibrio sp. MED222] gi|85834545|gb|EAQ52694.1| 4'-phosphopantetheinyl transferase family protein [Vibrio sp.
  misc_feature (7)..(274): NCBI GI: 218710182 Blast Desc: 4'-phosphopantetheinyl transferase [Vibrio splendidus LGP32] gi|218323201|emb|CAV19378.1| 4'-phosphopantetheinyl transferase [Vibrio splendidus LGP32]
  misc_feature (11)..(259): NCBI GI: 212636300 Blast Desc: 4'-phosphopantetheinyl transferase [Shewanella piezotolerans WP3] gi|212557784|gb|ACJ30238.1| 4'-phosphopantetheinyl transferase [Shewanella piezotolerans WP3]
  misc_feature (11)..(275): NCBI GI: 206570562 Blast Desc: 4'-phosphopantetheinyl transferase [Shewanella sp. BR-2]
  misc_feature (35)..(258): NCBI GI: 18542421 Blast Desc: AF467805_1 phosphopantetheinyl transferase [Shewanella sp. SC2A]
  misc_feature (35)..(258): NCBI GI: 149675712 Blast Desc: 4'-phosphopantetheinyl transferase [Shewanella livingstonensis]
  misc_feature (35)..(258): NCBI GI: 114562423 Blast Desc: 4'-phosphopantetheinyl transferase [Shewanella frigidimarina NCIMB 400] gi|114333716|gb|ABI71098.1| 4'-phosphopantetheinyl transferase [Shewanella frigidimarina 400]
  misc_feature (124)..(187): Pfam Id: PF01648 Pfam Desc: 4'-phosphopantetheinyl transferase superfamily
MSARKTETLVIDLWLCSLSDLDEDTDHVSRLKQKLTADEVAKVERYRMPSSQAQALYVRSCLRAILSRYSCLQPEEWRFEYGEKGKPSLVEKQQIETGLNFNISHSKEHLLIAVCQTKGQPLQLGVDIEHARSSTNIAAIMKHYFSEFEINDLLELDDVSQRERFFDLWALKESYIKATGKGLATSLKSFSFDFSNLTEQTLPVYSLDFQTELYGEIIVHNGVGLDVTEQGDVSADWQCSLGRLDDQFRFAVTLGGATLPVQLDMKCFPVAKLLG

SEQ ID NO: 107 - DNA, 3146 bp, Aliivibrio sp.
  misc_feature: 5' portion of PfaA gene
  misc_feature: SGI cDNA ID NO. 1511474
  misc_feature: Encodes the peptide sequence at SEQ ID NO 108
  misc_feature: Useful for modulating production of PUFA
atgtcaaaaaagcaaaccacaaacccagcgtcggataagcgactcaactctcgcttgcaagaaacgccgattgcaattgttggtatggcttcggtttttgctgagagtaaaaaccttggacaattttgggatactatcgttaattctgtgaatggcattcaagacgtgcctgaggaccgatgggctatcgatgattattattctgcagataaaaaagaagcggataaaagttattgtaagcgcggcgcttttttacctgagattgattttgatccaatggaatttggtttaccaccgaacttattagaattaacagatattactcaattaatggctttagtagttgcacgtgatgtattagctgatgctggtgtcggtgaagaaagcggtttcgaccgcgataaaatgggcatcattttaggtgtcggcggcggccaaaaacaaggtgggcaattaatgtctcgcctgcaaggtcctgtacttgaaaaagtgttaaaagcttcaggtcttagccaagatgatacgcaagttatcgtagaaaaatttaagaaggcttatattccctgggaagaaaattcgttccctgggatgttaggtaacgttattgctggacgtattgctaatcgttttaattttggtggtactaactgtgtggttgatgctgcatgtgcaggttcattatcagcgattaaaatggcggtgtcagatttattagaataccgttctgatatgatgttatcaggcggtatatgctgcgataactcaccattcatgtacatgtcattttctaaaacacctgcttttaccgacggtgattgtattcgtccttttgacgatcaatcgaacggaatgatgatcggtgaaggggtaggaatgatcgcactaaaacgtttagaagatgctgaacgtgacggtgatcgaatctattctgttatcaaaggtattggtagttcatccgatggtaaatttaaatctatttatgctcctcgtccagaagggcaattaaaagcattaaaacgtgcctatcaagatgccggttttgatccaaagacctgcggcttaattgaagctcatggtactggcacaaaagctggagatgctgcagagtttagaggcttagagttattatttagtgaaaataacgatcagaaacagcacgtggcccttggttctgttaagtctcaagtgggacataccaaagcagcagctggtgctgcgggtttaatcaaagcatcactagctttatatcataaggtgttacctgcgaccattaatgtagataaaccgaatcaaaacttagatattgaaaatacgcctttgtatatcaataccgaaaccagaccttggatgcaacgtgccgatggtgctaagcgtcaagcaggtattagctcatttggttttggcggtactaattttcatctagtgttagaagaatacacacaaagccaacaaggtgcatatcgattaaatgaagttgcacaaacatttttatttactgccgataataaacaatctttaataaataccttagaaacggagatagcttctttaaaggtggacattgaacaacaaccctatgcgcttaatcagttgatcctttcttatccgattaagaaagtagcagcacaaaaagcacgttgtggttttgtcgccaagggagttgatcaaacaattaagctattacaacaactgattgctcaattaaccacagataaaaatagtgagtggtcaacgcccactggactttattatcgtcaacaggcaatgccaactaatggcaaagtagtggctttattctctggtcaaggttctcaatatgtcaatatggggcgtgagttggtttgtcatttcccaagtatgatggctagccaagcacacatcgaccagcatttccatcaagcgagtgaaactagtctttctcagtttgtgtatcctattccagtttttgatcagcaaaaacgagaacaacaggaattagcgttaagagctacacaatatgcgcaacctgcgattggtagcttgtctgttggtttattcaatacatttaaacaagctggatttaaagcagattttgccgcaggacatagttttggtgagttgactgcattatgggctgcagaggttttatctgaagctgactatatgacattagcgaaggcacgcgggcaagccatgtcagctcctgacaatattaaacaaaatagtgaggcgtatgaccccggtactatggctgcagtgattgggaatataggtgatattgagtctagcattgaggcgattgaaggggtagaaattgccaattataacgccaataatcaagccgttattgcaggtacaaccgatgcgatagcaatcgcgacaacgcaattaactgacagcggctttaaagttatcgctttgccggtttctgctgcatttcatacgccgttagtaggtcacgcgcagcaaccttttgccgaagctatagatcgggttaaattcaacgatcctaagatagcagtgtattcgaatgcgacgggtgaagcgtacagtgatgatcataatcagatcaagtccacactaaaaaatcatattttacagtcagtacaatttagtaaagagatcaataatttgtatgatgctggtgggcgcatatttgttgaatttggtcctaaaaatgtattaacgcgattagttgataacattctaggcgataaaaatgatgtcgtgaccattgcaaccaatagcaatcctaagcaatgttcagatttacaattacgtttagctgcagtgcaaatggctgtgcttggcctggaactagataatattgacccatactcagcggttgttcgccctacaatagcacccaaaaaatccccgctagcaatgaagctttctggtgcatcctacgtcagtaataaaactaaaaaagcctttcaagatgaattaacagatggttggaaagtcgcacaggcagtacctgtgtccacgccacaaatcaaagaagttattgttgaaaaagtagtagaaaaaatagttgagaaagttgtagaaaaaatagtctatgtagatagtcaaggtaagcctttagctgatcaaacaggcgctaatattcaaggccaagatagtcctcaattatctactaatactcctaataataaccaaca

SEQ ID NO: 108 - protein, 1048 aa, Aliivibrio sp.
  misc_feature: N-terminal portion of PfaA polypeptide
  misc_feature: SGI Peptide ID NO. 1511474
  misc_feature: Useful for modulating production of PUFA
  misc_feature (1)..(1037): NCBI GI: 119945395 Blast Desc: pfaA gene product [Psychromonas ingrahamii 37] gi|119863999|gb|ABM03476.1| polyunsaturated fatty acid synthase PfaA [Psychromonas ingrahamii 37]
  misc_feature (1)..(1026): NCBI GI: 149909575 Blast Desc: polyunsaturated fatty acid synthase PfaA [Moritella sp. PE36] gi|149807279|gb|EDM67232.1| polyunsaturated fatty acid synthase PfaA [Moritella sp. PE36]
  misc_feature (1)..(1022): NCBI GI: 90408112 Blast Desc: omega-3 polyunsaturated fatty acid synthase PfaA [Psychromonas sp. CNPT3] gi|90310798|gb|EAS38913.1| omega-3 polyunsaturated fatty acid synthase PfaA [Psychromonas sp. CNPT3]
  misc_feature (1)..(1020): NCBI GI: 111548647 Blast Desc: protein product [Moritella marina]
  misc_feature (1)..(1043): NCBI GI: 71277928 Blast Desc: polyunsaturated fatty acid synthase PfaA [Colwellia psychrerythraea 34H] gi|71143668|gb|AAZ24141.1| polyunsaturated fatty acid synthase PfaA [Colwellia psychrerythraea 34H]
  misc_feature (2)..(1012): NCBI GI: 325974032 Blast Desc: omega-3 polyunsaturated fatty acid synthase PfaA [Shewanella sp. MAR441]
  misc_feature (2)..(1012): NCBI GI: 15488031 Blast Desc: AF409100_7 omega-3 polyunsaturated fatty acid synthase PfaA [Photobacterium profundum SS9]
  misc_feature (2)..(1012): NCBI GI: 54308653 Blast Desc: omega-3 polyunsaturated fatty acid synthase PfaA [Photobacterium profundum SS9] gi|46913082|emb|CAG19871.1| omega-3 polyunsaturated fatty acid synthase PfaA [Photobacterium
  misc_feature (2)..(1012): NCBI GI: 90413869 Blast Desc: omega-3 polyunsaturated fatty acid synthase PfaA [Photobacterium profundum 3TCK] gi|90325053|gb|EAS41563.1| omega-3 polyunsaturated fatty acid synthase PfaA [Photobacterium
  misc_feature (7)..(1045): NCBI GI: 160874571 Blast Desc: polyketide-type polyunsaturated fatty acid synthase PfaA [Shewanella baltica OS195] gi|378707821|ref|YP_005272715.1| polyketide-type polyunsaturated fatty acid synthase PfaA baltica
  misc_feature (22)..(301): Pfam Id: PF00109 Pfam Desc: Beta-ketoacyl synthase, N-terminal domain
  misc_feature (309)..(427): Pfam Id: PF02801 Pfam Desc: Beta-ketoacyl synthase, C-terminal domain
  misc_feature (598)..(922): Pfam Id: PF00698 Pfam Desc: Acyl transferase domain
MSKKQTTNPASDKRLNSRLQETPIAIVGMASVFAESKNLGQFWDTIVNSVNGIQDVPEDRWAIDDYYSADKKEADKSYCKRGAFLPEIDFDPMEFGLPPNLLELTDITQLMALVVARDVLADAGVGEESGFDRDKMGIILGVGGGQKQGGQLMSRLQGPVLEKVLKASGLSQDDTQVIVEKFKKAYIPWEENSFPGMLGNVIAGRIANRFNFGGTNCVVDAACAGSLSAIKMAVSDLLEYRSDMMLSGGICCDNSPFMYMSFSKTPAFTDGDCIRPFDDQSNGMMIGEGVGMIALKRLEDAERDGDRIYSVIKGIGSSSDGKFKSIYAPRPEGQLKALKRAYQDAGFDPKTCGLIEAHGTGTKAGDAAEFRGLELLFSENNDQKQHVALGSVKSQVGHTKAAAGAAGLIKASLALYHKVLPATINVDKPNQNLDIENTPLYINTETRPWMQRADGAKRQAGISSFGFGGTNFHLVLEEYTQSQQGAYRLNEVAQTFLFTADNKQSLINTLETEIASLKVDIEQQPYALNQLILSYPIKKVAAQKARCGFVAKGVDQTIKLLQQLIAQLTTDKNSEWSTPTGLYYRQQAMPTNGKVVALFSGQGSQYVNMGRELVCHFPSMMASQAHIDQHFHQASETSLSQFVYPIPVFDQQKREQQELALRATQYAQPAIGSLSVGLFNTFKQAGFKADFAAGHSFGELTALWAAEVLSEADYMTLAKARGQAMSAPDNIKQNSEAYDPGTMAAVIGNIGDIESSIEAIEGVEIANYNANNQAVIAGTTDAIAIATTQLTDSGFKVIALPVSAAFHTPLVGHAQQPFAEAIDRVKFNDPKIAVYSNATGEAYSDDHNQIKSTLKNHILQSVQFSKEINNLYDAGGRIFVEFGPKNVLTRLVDNILGDKNDVVTIATNSNPKQCSDLQLRLAAVQMAVLGLELDNIDPYSAVVRPTIAPKKSPLAMKLSGASYVSNKTKKAFQDELTDGWKVAQAVPVSTPQIKEVIVEKVVEKIVEKVVEKIVYVDSQGKPLADQTGANIQGQDSPQLSTNTPNNNQ

SEQ ID NO: 109 - DNA, 3162 bp, Aliivibrio sp.
  misc_feature: 3' portion of PfaA gene
  misc_feature: SGI cDNA ID NO. 1511521
  misc_feature: Encodes the peptide sequence at SEQ ID NO 110
  misc_feature: Useful for modulating production of PUFA
atggacatggaagcagatcttggtattgattcaattaaacgtgttgagatcttaggtgcagtgcaagatgaaattgttgatttaccagagttagatgccgagcagttatcacaaatgcgcactctaaatgaaattgtgacttatatgcattctgtgctgaaacctgagcaagtcgatactatatctacaacagcaggttctgcaccggtaaattctacaactttaaatgcatcaccaacaaaagataagccgataactgaaccggcagagttaactaacaatgttttactcgatcttaatgggattgaaaaagttatgttaactgtagttgctgataaaaccggttatcccattgaaatgcttgaattaagtatggatatggaagctgatttaggtattgattctattaaacgtgtagaaatcttaggatctgtgcaggatgaaatcacagagctgccagagttagatgctgaacagttagcacaaatgcgtaccttagatgaaattatacaatacatgcataacattcaatctagcacgatagtcataccggcttcggatacacaaattagctcagaaaaagcattaattttagaaagttcggtgacagagaataatttacaaatcaattatgttgttgatccttctccgagtgcgacggtagaaataaaaaagcttgcaacacttgagtgtattaactcaagtgttgataacaagaatcttctattagtcaatgatggtttaaatagctgtgtattgattgccaatgacttatctgcattaggttggaatgttagtgttttgacaccggcatgggtggcagagaaacagactaaatcctttgagcagaatattgagcgtttggctttacatgatctttgtgaaaacacattacagacattaatagaatcaaagaagcagtggcaatcggtgatttatctacatcctaaaacagcggttgaagggatcagctttacagaagatcataaaaaaggattacagttagcctttctgttagcgaagttaagtaaacttaatacaataaataatgatgaccgtgcgtcatttttggtgttaacacgccaaggtggtgattttgcaacgaataatatcgaacaaaaagcagatcttgtgcaaggtggactagctggtttagtgaaaacaatcgctcatgagtgggacaatgtgttttgtcgtattgttgatattcctagcaaatacgcagcgaataaagtggccaagatagtcgtcggtgaactcaatgacaaaaaaatattaccggttgaagtaggttttaatgaacaaggtcgtctttcgctagtagctaaaagcaccgacagttatcaattaccaagtgataataagttagataagaataatgtttttttggttagtggtggagctaaaggggtgacagcacattgtgtcattgaaattgctaaacaacaccaatgtaaatttattttgttaggtcgctcaagttatcaagctaaagaagatgattggtcacttagtcatgccactgaggtggagctaaaaaaagctgctatgcaacatttgctcaatacaggtgaaaaaccaagtcctaagttgatcaaacaattaattgggccggtacttgctaaccgtgaaataacacaaacattacagagtattgcagctttcggaggtattgctgaatacgttagcgcggatgtttgcgaccaagaaaaccttaaagcaatgattcaaccaatttgtgatttgtggggtccgattactggtgttattcatggcgctggtgtactagcagataaatttattgaacaaaaaacactggctgagtttgagcaggtatataacactaaaattcaaggattagatgcattgttagcttgttgtgagttgagtacattacaacatttagtgttattttcttctgcggcaggcttttatggtaaccctggtcaatctgattatgcgattgctaatgaaattcttaataaagttgcttaccgttttaaagctttatatccagcggcgcaagtgcttagttttaattggggaccatgggatggtggtatggttacagcagagttgaaacgtatgtttgatcaacgtggtgtattcataatccctattcaatcaggagtgaaattactggccagtgagctggcggctaatagtaatcgttgtgtgcaaattgtagtcggtacagatatgtctggtaaccgtgatgctttaaatactcatgatacaactgctaactatgattcctcaaccaaaatgtgtgcgtcagaggttggtaatcaatcattaatgggggtcagcaaagcagtgacaaaaacctttaaccccgataatagtttattgattgcagatcataaaattgatgggcaacaagttttacctactgtatgcgcgatggcttggatgcgttcgacttgtgaagaccagtatcctgacttctcttatcaaagtattgagcactttaagttgttaaaaggtattatttttgatggcaaacaagcaacacaatacctgattaatacaaccgttatcggtgaatatgattcatctattgctattgaagtagtggtgagtagtgaaagtaaatcttctaaaccattctatcactatcgtgccatattgaatttatacaagccgaatcataagccaaatgctcagcaaataatgtatcaagggattttaccacagcgagtaagcaaacagtctgcacaagctaacgctttgtattcagacggcagtttattccatggtgaaagtttacaaggtattaaacatgttcatcaattagatgaatctggtttattaatcgaatgtgttattgaacctgatacgcttgctgcacaaggtgaatttttattagctgacaataatgtgttagccaatgatttggtatatcaagctctgttagtgtggacaagtaaagtaatgggtgccggtagtttgccaacaagcacagagcaatggcagttatttcgtgatgtgaaagtaggtgaagatttctttataaaattgactatcactaaacaatcaggacagtctgtgttaggcgatcttttattgattgatcaaaataatcgagtgattagtaaaataactgcagcagaagtaacctgtagcgcaagtttacgtgaattatttaaggctagcgcttaa

SEQ ID NO: 110 - protein, 1053 aa, Aliivibrio sp.
  misc_feature: C-terminal portion of PfaA polypeptide
  misc_feature: SGI Peptide ID NO. 1511521
  misc_feature: Useful for modulating production of PUFA
  misc_feature (1)..(1050): NCBI GI: 119945395 Blast Desc: pfaA gene product [Psychromonas ingrahamii 37] gi|119863999|gb|ABM03476.1| polyunsaturated fatty acid synthase PfaA [Psychromonas ingrahamii 37]
  misc_feature (1)..(1053): NCBI GI: 90408112 Blast Desc: omega-3 polyunsaturated fatty acid synthase PfaA [Psychromonas sp. CNPT3] gi|90310798|gb|EAS38913.1| omega-3 polyunsaturated fatty acid synthase PfaA [Psychromonas sp. CNPT3]
  misc_feature (1)..(1049): NCBI GI: 71277928 Blast Desc: polyunsaturated fatty acid synthase PfaA [Colwellia psychrerythraea 34H] gi|71143668|gb|AAZ24141.1| polyunsaturated fatty acid synthase PfaA [Colwellia psychrerythraea 34H]
  misc_feature (1)..(1048): NCBI GI: 111548647 Blast Desc: protein product [Moritella marina]
  misc_feature (1)..(1048): NCBI GI: 149909575 Blast Desc: polyunsaturated fatty acid synthase PfaA [Moritella sp. PE36] gi|149807279|gb|EDM67232.1| polyunsaturated fatty acid synthase PfaA [Moritella sp. PE36]
  misc_feature (1)..(1049): NCBI GI: 170725784 Blast Desc: polyketide-type polyunsaturated fatty acid synthase PfaA [Shewanella woodyi ATCC 51908] gi|169811131|gb|ACA85715.1| polyketide-type polyunsaturated fatty acid synthase PfaA woodyi
  misc_feature (1)..(1049): NCBI GI: 90413869 Blast Desc: omega-3 polyunsaturated fatty acid synthase PfaA [Photobacterium profundum 3TCK] gi|90325053|gb|EAS41563.1| omega-3 polyunsaturated fatty acid synthase PfaA [Photobacterium
  misc_feature (1)..(1051): NCBI GI: 91793978 Blast Desc: beta-ketoacyl synthase [Shewanella denitrificans OS217] gi|91715980|gb|ABE55906.1| beta-ketoacyl synthase [Shewanella denitrificans OS217]
  misc_feature (1)..(1049): NCBI GI: 15488031 Blast Desc: AF409100_7 omega-3 polyunsaturated fatty acid synthase PfaA [Photobacterium profundum SS9]
  misc_feature (1)..(1049): NCBI GI: 325974042 Blast Desc: omega-3 polyunsaturated fatty acid synthase PfaA [Vibrio sp. NSP560]
  misc_feature (6)..(48): Pfam Id: PF00550 Pfam Desc: Phosphopantetheine attachment site
  misc_feature (107)..(172): Pfam Id: PF00550 Pfam Desc: Phosphopantetheine attachment site
  misc_feature (461)..(686): Pfam Id: PF08659 Pfam Desc: KR domain
  misc_feature (544)..(667): Pfam Id: PF00106 Pfam Desc: short chain dehydrogenase
MDMEADLGIDSIKRVEILGAVQDEIVDLPELDAEQLSQMRTLNEIVTYMHSVLKPEQVDTISTTAGSAPVNSTTLNASPTKDKPITEPAELTNNVLLDLNGIEKVMLTVVADKTGYPIEMLELSMDMEADLGIDSIKRVEILGSVQDEITELPELDAEQLAQMRTLDEIIQYMHNIQSSTIVIPASDTQISSEKALILESSVTENNLQINYVVDPSPSATVEIKKLATLECINSSVDNKNLLLVNDGLNSCVLIANDLSALGWNVSVLTPAWVAEKQTKSFEQNIERLALHDLCENTLQTLIESKKQWQSVIYLHPKTAVEGISFTEDHKKGLQLAFLLAKLSKLNTINNDDRASFLVLTRQGGDFATNNIEQKADLVQGGLAGLVKTIAHEWDNVFCRIVDIPSKYAANKVAKIVVGELNDKKILPVEVGFNEQGRLSLVAKSTDSYQLPSDNKLDKNNVFLVSGGAKGVTAHCVIEIAKQHQCKFILLGRSSYQAKEDDWSLSHATEVELKKAAMQHLLNTGEKPSPKLIKQLIGPVLANREITQTLQSIAAFGGIAEYVSADVCDQENLKAMIQPICDLWGPITGVIHGAGVLADKFIEQKTLAEFEQVYNTKIQGLDALLACCELSTLQHLVLFSSAAGFYGNPGQSDYAIANEILNKVAYRFKALYPAAQVLSFNWGPWDGGMVTAELKRMFDQRGVFIIPIQSGVKLLASELAANSNRCVQIVVGTDMSGNRDALNTHDTTANYDSSTKMCASEVGNQSLMGVSKAVTKTFNPDNSLLIADHKIDGQQVLPTVCAMAWMRSTCEDQYPDFSYQSIEHFKLLKGIIFDGKQATQYLINTTVIGEYDSSIAIEVVVSSESKSSKPFYHYRAILNLYKPNHKPNAQQIMYQGILPQRVSKQSAQANALYSDGSLFHGESLQGIKHVHQLDESGLLIECVIEPDTLAAQGEFLLADNNVLANDLVYQALLVWTSKVMGAGSLPTSTEQWQLFRDVKVGEDFFIKLTITKQSGQSVLGDLLLIDQNNRVISKITAAEVTCSASLRELFKASA

SEQ ID NO: 111 - DNA, 2889 bp, Aliivibrio sp.
  misc_feature: PfaB gene
  misc_feature: SGI cDNA ID NO. 1511523
  misc_feature: Encodes the peptide sequence at SEQ ID NO 112
  misc_feature: Useful for modulating production of PUFA
atgcttgctgtgatcggtttagggattcgttttgcatcagtaaaagatactgatgcattcgattaccacctatacagaaatcaatcagttccattagtaaagcaggactctttcgggcctgttttaacagatgcagaaagggtgatagagcagttattaacggtaaaccatttatctggcgatgatattcatttattgattgtagatgaggataagtcatttgttcagaaaaataccaccaatacagtgaatattaagctgtcatctgttttgcagccattgttatccagtactgattttttttctgttagtactgtttcttcgatcacagatgcattaaaaacagcacaagaggtaagttttgtcactaatgcagacaatgacaagcttaactatcctcactcattgaaacgcaatatcagcaatgtaaacagtaaagctgtaattattctttctattaatcagcaacatttagatggtgtgactgcactattagtttgcgataaagttttacttgagcaacccctatcgcaatttcacttgtgtcattgttatgcggaaattaatgcattttctgctttgaattatacaaaaaaaactttcgatgttgaagtgagtgaacatatacaagatttcttatcgactaatgatattaactgtaatgaagttgaatctgttattactggagagtttacagcgcaagaatatataagtgacccaaaaaaatattatcaacatcaacatcaaagcaattggtttaatgcgtttcaatctctatctaaacaacaagttcgaacttcatctagtcaaaatgaagcaactattgtcaatcaagccaagacaacattattgacgtcagtagaatgtattcgcactgattcggcaaactttaatactttagtatcgttggttgcagctatattatgtttagatcagcgctatcggttaggttgtaaacaaagcctagttcagaagcagaataaaaagcagtgtgtaaaggaaactaatggccaagcaccatcagtcaacgattggcaacattcagctttttattatctaggctattcgagcagttatttaagtaataaagcaaacgatgcttcaataactagacctcgccgagtaatagtaagccatatagactatgtaagcgatttgaaagttgtcaacgctacaaataccaacaccgctaacagggactgtactaccaaatacggtgctataaatactggcaaagttgacgaaaatatcaatttaaaccagctacatcaattgtttagtgtgtccgcaataaatgcaaaagaaggtgaaaattttaacgtaaataatggttttttagcacagcatgcattaaaaccagtgatttttcgtgcttcaaacatgccattattgttaaagtttttaaagcaaacattatcgcaagcaacggacctaaactcctcaggtcaaacatgttcttttgttgaatttgttaaacaaaaaaataacttagctaatttaagtaatgttcaagtggatctccaagataagaaccaaagcaatcatcatctcaccatgggtgagggggctcagatgcaattttgtgtagtgctgttagcgtcttcatttacaacgttagcgcaacaaatacaactagccctagcgggggttagtgttgcacagcaaaataataaaccttggaaaacacctgttgggagttactttagtgggcaagcagtgagtttctgtaaagcaaaaaaaccacttagctttatttatccaggtgttggcgcgttatacgtcaatatgggcaaagatttactgcgtttatttcctcagtgttggcaatcattatccagactcagtgatgatcttgcacatagcttacaagatacgctgctaacgccacgcttaatagacgaagttgaccttgaaatgtcctctgcgctagaaaaatcgttacgttcagaattagccaatatcgctgaagcaggggttagctatggttgtttgttaacgaatattttccagcaacaacttggcctgaaagcaaccagtgccgcgggttatagcatgggcgaagtgagcatgtttgctgcgttagactgctgggaaacaccacaattaatgagccaacgtttcagaaatagcgaggtgtttactgagcagttatcaggcccgttaaaacgcttacaaaggattcaaataaacagcccagataaaatcattaaaaacagtgttagtttaaaacctgaacaagcattgtgggagtcttatcatctcaaagcgggccttttgcaggttgagtccattattgatgaattcccaagagtttatatcactattatcaatacacctgagagtttggttattgctggtgtacctgaacaatgtctagcattagccaaacgattaaatttgcgcgctattgctttgaatgttcacaacatcattcactgtgagttggcaaaaagcgaatacgaaaacatgttgcaactgtattcattaccgattaaacaaaaaataagttgccaactattttcaagttcttgttatttgccgatacctataacggagaaagccattgccgtgagcattagtaaatgtttaacggaattagttgattttcctcgtttaataaaaaaaatagcggcatcaggtgaaactgtctttattgagatgggggcgggtaaatcccttagcacttggattgaacgaattttaaaaaagagcagccagccaattacttgtctatcggttaaccaaaaaaaattagatgatcatagtgctattttaaaatccatcgctgccttgttgagccttggttatcctattcatttacaggctttttttagtggttcattaatccgacccgttaaaaaattgcctgctttagtatcagtatcatag

SEQ ID NO: 112 - protein, 962 aa, Aliivibrio sp.
  misc_feature: PfaB polypeptide
  misc_feature: SGI Peptide ID NO. 1511523
  misc_feature: Useful for modulating production of PUFA
  misc_feature (2)..(950): NCBI GI: 90408111 Blast Desc: heterocyst glycolipid synthase [Psychromonas sp. CNPT3] gi|90310797|gb|EAS38912.1| heterocyst glycolipid synthase [Psychromonas sp. CNPT3]
  misc_feature (271)..(954): NCBI GI: 71279011 Blast Desc: polyunsaturated fatty acid synthase PfaB [Colwellia psychrerythraea 34H] gi|71144751|gb|AAZ25224.1| polyunsaturated fatty acid synthase PfaB [Colwellia psychrerythraea 34H]
  misc_feature (518)..(945): NCBI GI: 17232847 Blast Desc: hglC gene product [Nostoc sp. PCC 7120] gi|17134494|dbj|BAB77054.1| heterocyst glycolipid synthase [Nostoc sp. PCC 7120]
  misc_feature (521)..(952): NCBI GI: 119945396 Blast Desc: polyunsaturated fatty acid synthase PfaB [Psychromonas ingrahamii 37] gi|119864000|gb|ABM03477.1| polyunsaturated fatty acid synthase PfaB [Psychromonas ingrahamii 37]
  misc_feature (523)..(933): NCBI GI: 17229135 Blast Desc: [Nostoc sp. PCC 7120] gi|17135463|dbj|BAB78009.1| all1643 [Nostoc sp. PCC 7120]
  misc_feature (525)..(940): NCBI GI: 37521526 Blast Desc: glycolipid synthase [Gloeobacter violaceus PCC 7421] gi|35212523|dbj|BAC89898.1| gll1957 [Gloeobacter violaceus PCC 7421]
  misc_feature (527)..(942): NCBI GI: 6691655 Blast Desc: protein product [Moritella marina]
  misc_feature (527)..(901): NCBI GI: 149909574 Blast Desc: polyunsaturated fatty acid synthase PfaB [Moritella sp. PE36] gi|149807278|gb|EDM67231.1| polyunsaturated fatty acid synthase PfaB [Moritella sp. PE36]
  misc_feature (527)..(945): NCBI GI: 354568593 Blast Desc: PfaB family protein [Fischerella sp. JSC-11] gi|353539847|gb|EHC09327.1| PfaB family protein [Fischerella sp. JSC-11]
  misc_feature (527)..(933): NCBI GI: 75910946 Blast Desc: beta-ketoacyl synthase [Anabaena variabilis ATCC 29413] gi|75704671|gb|ABA24347.1| Beta-ketoacyl synthase [Anabaena variabilis ATCC 29413]
  misc_feature (761)..(929): Pfam Id: PF00698 Pfam Desc: Acyl transferase domain
MLAVIGLGIRFASVKDTDAFDYHLYRNQSVPLVKQDSFGPVLTDAERVIEQLLTVNHLSGDDIHLLIVDEDKSFVQKNTTNTVNIKLSSVLQPLLSSTDFFSVSTVSSITDALKTAQEVSFVTNADNDKLNYPHSLKRNISNVNSKAVIILSINQQHLDGVTALLVCDKVLLEQPLSQFHLCHCYAEINAFSALNYTKKTFDVEVSEHIQDFLSTNDINCNEVESVITGEFTAQEYISDPKKYYQHQHQSNWFNAFQSLSKQQVRTSSSQNEATIVNQAKTTLLTSVECIRTDSANFNTLVSLVAAILCLDQRYRLGCKQSLVQKQNKKQCVKETNGQAPSVNDWQHSAFYYLGYSSSYLSNKANDASITRPRRVIVSHIDYVSDLKVVNATNTNTANRDCTTKYGAINTGKVDENINLNQLHQLFSVSAINAKEGENFNVNNGFLAQHALKPVIFRASNMPLLLKFLKQTLSQATDLNSSGQTCSFVEFVKQKNNLANLSNVQVDLQDKNQSNHHLTMGEGAQMQFCVVLLASSFTTLAQQIQLALAGVSVAQQNNKPWKTPVGSYFSGQAVSFCKAKKPLSFIYPGVGALYVNMGKDLLRLFPQCWQSLSRLSDDLAHSLQDTLLTPRLIDEVDLEMSSALEKSLRSELANIAEAGVSYGCLLTNIFQQQLGLKATSAAGYSMGEVSMFAALDCWETPQLMSQRFRNSEVFTEQLSGPLKRLQRIQINSPDKIIKNSVSLKPEQALWESYHLKAGLLQVESIIDEFPRVYITIINTPESLVIAGVPEQCLALAKRLNLRAIALNVHNIIHCELAKSEYENMLQLYSLPIKQKISCQLFSSSCYLPIPITEKAIAVSISKCLTELVDFPRLIKKIAASGETVFIEMGAGKSLSTWIERILKKSSQPITCLSVNQKKLDDHSAILKSIAALLSLGYPIHLQAFFSGSLIRPVKKLPALVSVS

SEQ ID NO: 113 - DNA, 6006 bp, Aliivibrio sp.
  misc_feature: PfaC gene
  misc_feature: SGI cDNA ID NO. 1511515
  misc_feature: Encodes the peptide sequence at SEQ ID NO 114
  misc_feature: Useful for modulating production of PUFA
atggaaaacatcgccattgtaggtattgctaatttgtttcctgggtcgagtgcacctgaagagttttggcaacaattactaaagcaacaagataatcgtacaccaatcactgaacatgaattaggtgttaatccaaacgattatctaggccgcaagggtcaaagcgataaatattattgtttatatggtggttatattcgtgattttaacttcgatggcagtgagtatattgctagtaaaagtgtatcaagtcaaaggaggctcctaactgccgatgacttaaaccagctagacgatttacatcaatggtcgttgtacgtgactaaacgagctttacaggatgcagggtattggcacagtgaaaaattaaatgattgtgggttgattctaggtaacctttcttttccgaccaagcaatctaatcatctttttttagatttatatcgagatgtcgtagaacttgcgttacagcaaacaattgactcaaggtttcaactgtctacttttgcagctactaaaaacgtttctccttatagtgcacttgttgctggttatcccgctgctttattagctgaagttaatggcctaggtggcaattatttttccctggatgcagcctgtgcatcatcatgttatagcgtcaaattagcctgtgattatttacagactggtaaagctaatatgatgttagcgggtgcggtttctgctgcggattctttatttgtgaacatgggattttcaatcttccaagcttttcctgaaaataatcgacatgctccctttgatcaagattcgcaagggttatttgctgcacaaggtgcaggcatgatggtgcttaaacgacatagtgatgccattaatgatggagaccgtattcatgctgtgataaaaggtggggctttaactaatgatggcaaaggggagtttgtacttagtcctaatagtaaagggcaaatattagcttatcaagaagcctacaaagatgcgcaaattgatccaagagagattgattacattgaatgtcatgcaacgggtacaccaaaaggtgataaagttgaattaagctccatggaacagttttttagtcaatacgatcataaacctttgcttggatctgcaaaatctaacctcggtcatctattaacagctgcaggtatgcctgcaatgacaaaagctatttatgcacttaatgagaaaataatccctgcgaccattaatgttaataatgccattgccactaaacagggatacttttcagcacaacagatcccgactcaaaatataacatggcctgaaacggcacattcactaggttataaacatcaaaatacagctggtgttagtgtgtttggatttggtggtagtaatgcacatatagtgctgcaagcgggtgatagctctgaaacaaaaaattcaaattcactcaatcctgtgcagagtcttgctattgttgggatagattgccactttggttcgattgataatgcattcgattaccagcagttattgaaaagtcacgacaatggtttcgtcgacttaccaaataaacgttggcaaggaattgataagcaaacaacagtactgaatcgaatggaattacaaaaagcccctaaagggagctatataagtgaatttgagatagactttttacgctttaagatcccgcctaatgatcaagatagcttgataccacaacagttattaatgatgaaagtggctgataatgcagcaaaagatgctaacttagcgccaggtagtaacgttgctgttttggtcgctatgggattagagcttgaccttcaccaatatcgagggcgtgttaacctacaaagccaaattcagcaaagtttatctgctcaggggatagaattaactaaagagcagttggctgaattgattgctattagtaaacagggtattaatgagcctgcacagttaaaccaatacactagttttattggtaatattatggcttcaaggatttccgcattatgggattttagtggtcctgcctttacggtttctagtgaagaaaactctgtctacaaatgcattgatatagctgataatttatttaaaaccagtgctgtcgaagcggttattattgccagtgttgatttggcaggtagtatcgaaaatatttcactgaggcaacgttttagtgcaagtgaactggtgcctatggaaaatcgagttgctgaaaatgcatatattcaatcccaccctgaacaacagttacagtggttagtaggagaaggcgctggcgctattgttgttaaagcaaattttgctaaagagcacacacaagcaaaggatttagaaggtaacaagtcgcaactgaagagctctcgagttaaccatcctgatacagtttacgctaatattgaagctgttaactttgcccctaatctcaatgcacagagtaatgctgaggttatttcttgtgcattagcaaaagcacaggtcagcgcaccacaaatcactcacgttgaagcttttgctgcaggtaatcaacggcaattaacagatgagcaccatactttaacttcgctttatgcaaatgcttctattgtttctagcaagcaaaaaatagggcattgttataacgcttcgggcatggcgagtcttattgcaagtatattcgctgttcaggaaaacaaacaaacagacagcaaacaaaataatgttaccgcgccaatttgttatgccgcattaaatgggttaggaatggataacagtattgcccatcttattctgtctaatgtaaacgcgactaaaattgttacaaagcaaacaataaagccatctaaaccagggttagttaagacggtaaccctaggcggtaaatcgatttttgattgtatttgccaacaacaacaaaatccactcattgaacaaatacaatactcatttaacgcgcagtttaaagctcctgaagtgggctatttaaatgcctccatcaatactgctaatagcaggaataatgttgaaacgatgaacgaaataacacaaaaaataacagacaatattaacagtactgttgaagaaatagagaaacaaaaagagtatagccaagtagtaagccaagtgagtagtcaaattgagcaacaaagccaaactcatcaagcatttttacgggctcgatttatggctgaaaagcaaatatctactttgatcaagcttcaggctcagattgtaaatgggcagcaattgccgatggctaataatcaaacagttaatccatcttatactacgacagttgagaaccctttacataattcaattcaaacatcgaccaacacagttggtttattgtcgattaagggacaaagtgggtatgactatccacctttgcagctaattcctaaatacaacaaaccttctaaaattgtttttgataatgcgcaattggtggagttcgcagaaggtaatattggcaatgtatttggacagcaatatgcggtcattgatagctataaacgcagggtgcgtttaccgactacggattacttgttggtaagccgagttactgaacttagtgcacaaacacatcaatataaaaaatcttccatggttacagagtatgacattcctttggatgcgccttttttaattgatggtcaaataccttggtcagtgtcggttgaatctggacaatgcgatcttatgttaatttcttatattggcattgattttcagaacaaaggcgagcgagtatatcggttattagactgtgaattaacatttttagaagagatggcttttggtggtgaaaccttgcgctatgaaattcatattgactcttatgctaaaaatggtgagcagttattgtttttcttccattacgattgttttgttggtgataaaaaagtgttaataatgcgcaatggttgtgctggtttcttcaccgatgaggagctagccgatggaaaaggcgtgattgcaactgctaatgataaagctcaatacgatagcgcaataaaatcctcatttatccctttaatcgctaacactcaaacacaatatgattataaatcgatgttaaaactagtacatggtgatatcaaagggtgtttgggtgatgcttatgatcaacagggccgtaatccttcattgaagttctcttctgaaaaattcttaatgattgaacggatcactaaaattgaaaaaaatggtggtcattggggactcggcttactagaagggcaaaaacaattagatcctgagcattggtattttccttgtcactttaaagatgaccaagtgatggctggctcgttaatgtctgaaggttgtggtcaaatggcaatgttctttatgctctggttaggcatgaatactgatgtcaataatgctcgtttccagccgatggccggtgaagcgcaaacggttcgttgccgtggtcaagttagacctcaaactaatacattgacctatagaatggaagtgactgaaattggtatgtcacctcgtccatttattaaagcaaatatcgatattatactggatagtaaagttgtcgtagattttaaaaatctatgtgtggaaataaaagagcaagataaaacaagcccttatcctgtatcactcccagtgaatgtgcaacgcatcgatggtgcggaaaatgttttaatagagcaattgaataaagaggagactctaagtagtgccactttaaattttaagaaacaacaaaacgttattgatcaacacagtatcgacgaacgaggtatcaaaccgtttttgaatactaaaagaccattgatgcgtgttgtgtcagatttgaatgcctctactaataaaggtgtagtgccaatacagcactttgcagctccttattttgaagggcagaatagacagccagatacgctaccttttacaccttggcacctgtttgaatttgcaacgggcaatattagtcagtgctttggtcaggattttgatgtttatcaaggcagaacgccgcctagaacaccctgtggcgatttacaggtagttactcaggttgttgatgtgcaaggccagcgtatggattttaaaacgcctgcgagctgtatcgctgaatatgttgttccagaagatgcgtggtattttgctaaaaatagctgtgataattggatgccttattcgctactaatggagattgcattacaaccaaacggatttatctctgcttatatgggcactactttaaaatacccggaaaaagatctctattttcgtaatttagacggtcacggcgaaatcattacgcagatcgatttacgtggtaaaaccatcgttaataagtctgtgttgttatcaacgagcatggccggtggtgcaatcattcaaagttttaatttcgaattaagtgtagatgcacaaataatataccgtggaggagcagtttttggtttcttcagtgctgactcattaactaaccagttgggtatcgataacggacacgtcactcaaccgtggtttgtagaacataatattgcgacatcagatattacacgaattgatcttacagatgatacactgagtttattcaactcatctgcacaaaagcctaattatcgcttagctggcgggcaattaaactttgttgataccgtaagtattgttgaaggaggtggagatcatcaattagcttacatttacgggcaacgccgcattgatgcgagtgattggttcttccgttaccatttccatcaagatcctgtaatgcctggttctttaggcgtggaagccattatcgagttgttgcaatgctatgcgttaacaaatgatttaggaaagcaattcattaaccctcgttttattgcgccaacaaccaaggttgcgtggaaataccgtggacaaattacgcctcttaatgaacaaatgagtttggatgtgcacctaaaagagattattactagcccatcggaagtgcgcttgataggggatgctaatttatcaaaagatggtttacgtatttatcaagtgaaagacattgtcctgagtatcgttgaagcttaa

SEQ ID NO: 114 - protein, 2001 aa, Aliivibrio sp.
  misc_feature: PfaC polypeptide
  misc_feature: SGI Peptide ID NO. 1511515
  misc_feature: Useful for modulating production of PUFA
  misc_feature (1)..(2001): NCBI GI: 91793980 Blast Desc: 3-hydroxyacyl-ACP dehydratase [Shewanella denitrificans OS217] gi|91715982|gb|ABE55908.1| Beta-hydroxyacyl-(acyl-carrier-protein) dehydratase, FabA/FabZ
  misc_feature (2)..(285): Pfam Id: PF00109 Pfam Desc: Beta-ketoacyl synthase, N-terminal domain
  misc_feature (4)..(2001): NCBI GI: 325974036 Blast Desc: omega-3 polyunsaturated fatty acid synthase PfaC [Shewanella sp. MAR441]
  misc_feature (4)..(2001): NCBI GI: 120599576 Blast Desc: Beta-hydroxyacyl-(acyl-carrier-protein) dehydratase, FabA/FabZ [Shewanella sp. W3-18-1] gi|146292427|ref|YP_001182851.1| dehydratase, FabA/FabZ CN-32]
  misc_feature (4)..(2001): NCBI GI: 90413867 Blast Desc: omega-3 polyunsaturated fatty acid synthase PfaC [Photobacterium profundum 3TCK] gi|90325051|gb|EAS41561.1| omega-3 polyunsaturated fatty acid synthase PfaC [Photobacterium
  misc_feature (4)..(2001): NCBI GI: 218710185 Blast Desc: omega-3 polyunsaturated fatty acid synthase PfaC [Vibrio splendidus LGP32] gi|218323204|emb|CAV19381.1| PfaC, omega-3 polyunsaturated fatty acid synthase [Vibrio splendidus
  misc_feature (4)..(2001): NCBI GI: 157962728 Blast Desc: beta-hydroxyacyl-(acyl-carrier-protein) dehydratase FabA/FabZ [Shewanella pealeana ATCC 700345] gi|157847728|gb|ABV88227.1| dehydratase FabA/FabZ [Shewanella
  misc_feature (4)..(2001): NCBI GI: 86147637 Blast Desc: omega-3 polyunsaturated fatty acid synthase PfaC [Vibrio sp. MED222] gi|85834548|gb|EAQ52697.1| omega-3 polyunsaturated fatty acid synthase PfaC [Vibrio sp. MED222]
  misc_feature (4)..(2001): NCBI GI: 167624924 Blast Desc: beta-hydroxyacyl-(acyl-carrier-protein) dehydratase FabA/FabZ [Shewanella halifaxensis HAW-EB4] gi|167354946|gb|ABZ77559.1| dehydratase FabA/FabZ [Shewanella
  misc_feature (7)..(2001): NCBI GI: 371994230 Blast Desc: beta-hydroxyacyl-(acyl-carrier-protein) dehydratase FabA/FabZ [Shewanella baltica OS183] gi|373948818|ref|ZP_09608779.1| 6-deoxyerythronolide-B synthase.,
  misc_feature (7)..(2001): NCBI GI: 386313103 Blast Desc: multi-domain beta-ketoacyl synthase, PfaC [Shewanella putrefaciens 200] gi|319425728|gb|ADV53802.1| multi-domain beta-ketoacyl synthase, PfaC [Shewanella putrefaciens 200]
  misc_feature (293)..(407): Pfam Id: PF02801 Pfam Desc: Beta-ketoacyl synthase, C-terminal domain
  misc_feature (481)..(760): Pfam Id: PF00109 Pfam Desc: Beta-ketoacyl synthase, N-terminal domain
  misc_feature (799)..(886): Pfam Id: PF02801 Pfam Desc: Beta-ketoacyl synthase, C-terminal domain
  misc_feature (1377)..(1510): Pfam Id: PF07977 Pfam Desc: FabA-like domain
  misc_feature (1859)..(1992): Pfam Id: PF07977 Pfam Desc: FabA-like domain
MENIAIVGIANLFPGSSAPEEFWQQLLKQQDNRTPITEHELGVNPNDYLGRKGQSDKYYCLYGGYIRDFNFDGSEYIASKSVSSQRRLLTADDLNQLDDLHQWSLYVTKRALQDAGYWHSEKLNDCGLILGNLSFPTKQSNHLFLDLYRDVVELALQQTIDSRFQLSTFAATKNVSPYSALVAGYPAALLAEVNGLGGNYFSLDAACASSCYSVKLACDYLQTGKANMMLAGAVSAADSLFVNMGFSIFQAFPENNRHAPFDQDSQGLFAAQGAGMMVLKRHSDAINDGDRIHAVIKGGALTNDGKGEFVLSPNSKGQILAYQEAYKDAQIDPREIDYIECHATGTPKGDKVELSSMEQFFSQYDHKPLLGSAKSNLGHLLTAAGMPAMTKAIYALNEKIIPATINVNNAIATKQGYFSAQQIPTQNITWPETAHSLGYKHQNTAGVSVFGFGGSNAHIVLQAGDSSETKNSNSLNPVQSLAIVGIDCHFGSIDNAFDYQQLLKSHDNGFVDLPNKRWQGIDKQTTVLNRMELQKAPKGSYISEFEIDFLRFKIPPNDQDSLIPQQLLMMKVADNAAKDANLAPGSNVAVLVAMGLELDLHQYRGRVNLQSQIQQSLSAQGIELTKEQLAELIAISKQGINEPAQLNQYTSFIGNIMASRISALWDFSGPAFTVSSEENSVYKCIDIADNLFKTSAVEAVIIASVDLAGSIENISLRQRFSASELVPMENRVAENAYIQSHPEQQLQWLVGEGAGAIVVKANFAKEHTQAKDLEGNKSQLKSSRVNHPDTVYANIEAVNFAPNLNAQSNAEVISCALAKAQVSAPQITHVEAFAAGNQRQLTDEHHTLTSLYANASIVSSKQKIGHCYNASGMASLIASIFAVQENKQTDSKQNNVTAPICYAALNGLGMDNSIAHLILSNVNATKIVTKQTIKPSKPGLVKTVTLGGKSIFDCICQQQQNPLIEQIQYSFNAQFKAPEVGYLNASINTANSRNNVETMNEITQKITDNINSTVEEIEKQKEYSQVVSQVSSQIEQQSQTHQAFLRARFMAEKQISTLIKLQAQIVNGQQLPMANNQTVNPSYTTTVENPLHNSIQTSTNTVGLLSIKGQSGYDYPPLQLIPKYNKPSKIVFDNAQLVEFAEGNIGNVFGQQYAVIDSYKRRVRLPTTDYLLVSRVTELSAQTHQYKKSSMVTEYDIPLDAPFLIDGQIPWSVSVESGQCDLMLISYIGIDFQNKGERVYRLLDCELTFLEEMAFGGETLRYEIHIDSYAKNGEQLLFFFHYDCFVGDKKVLIMRNGCAGFFTDEELADGKGVIATANDKAQYDSAIKSSFIPLIANTQTQYDYKSMLKLVHGDIKGCLGDAYDQQGRNPSLKFSSEKFLMIERITKIEKNGGHWGLGLLEGQKQLDPEHWYFPCHFKDDQVMAGSLMSEGCGQMAMFFMLWLGMNTDVNNARFQPMAGEAQTVRCRGQVRPQTNTLTYRMEVTEIGMSPRPFIKANIDIILDSKVVVDFKNLCVEIKEQDKTSPYPVSLPVNVQRIDGAENVLIEQLNKEETLSSATLNFKKQQNVIDQHSIDERGIKPFLNTKRPLMRVVSDLNASTNKGVVPIQHFAAPYFEGQNRQPDTLPFTPWHLFEFATGNISQCFGQDFDVYQGRTPPRTPCGDLQVVTQVVDVQGQRMDFKTPASCIAEYVVPEDAWYFAKNSCDNWMPYSLLMEIALQPNGFISAYMGTTLKYPEKDLYFRNLDGHGEIITQIDLRGKTIVNKSVLLSTSMAGGAIIQSFNFELSVDAQIIYRGGAVFGFFSADSLTNQLGIDNGHVTQPWFVEHNIATSDITRIDLTDDTLSLFNSSAQKPNYRLAGGQLNFVDTVSIVEGGGDHQLAYIYGQRRIDASDWFFRYHFHQDPVMPGSLGVEAIIELLQCYALTNDLGKQFINPRFIAPTTKVAWKYRGQITPLNEQMSLDVHLKEIITSPSEVRLIGDANLSKDGLRIYQVKDIVLSIVEA

SEQ ID NO: 115 - DNA, 1662 bp, Aliivibrio sp.
  misc_feature: PfaD gene
  misc_feature: SGI cDNA ID NO. 1511516
  misc_feature: Encodes the peptide sequence at SEQ ID NO 116
  misc_feature: Useful for modulating production of PUFA
atgacacaagcaactaataaagcagcacttattgaaatcaataaacaacaaattgattggaactggcaagtagccgcctctacactatctggtgaccctgtcagcttaaaaaatgcattattagcgactgataaaccgctatatttagctaaaatgaataatcatattgcagttactcaccaactaatgagtcatcaagacaatagcccaacagatgtttcctcaacttctattttaccggtactcgcatttgctcaagcgattaaagctgaagaacttggctcggctgactttaaaaaagcgcatggtgtaaaatatgcttatcatggtggtgctatggccaatggcattgcatcagtagagttagtgattgcattaggtcaagctggttttttatgttcatttggagctgctggacttattccagatgtaattgaagattctattaaacgtatccaaagtgcattgcctgatgggccatttgcggttaacttaattcatgctccgagtgaacaagcgcttgaatctggtgcggtagagcggtttttaaagttaggggttaacactgtagaagcttctgcatttttagccttaactgagcatattgtacattatcgcgtagctggtctttcacaaaatccagatggtagtattgctattaacaacaaggtcatcgcaaaaatttcacggaccgaagttgcagaacgattcatgtcacccgcgccgcaaaaattcttaacaaagttactggcagcaggaaaaataacagcactgcaggccgagcttgcgctgcaagtgcctatggccgatgatattactgctgaagcagactctggtgggcacaccgataaccgtccttttttaacacttctgcccactattataaaacaacgtgatcagttacaagaaaaatataactatgtgacgccactgcgtgtcggtgccggtggcggaataggaacccctgaatctgctttagcagcatttaatatgggcgctgcttacatcgtgctaggttcagttaatcaagcttgtttagaagcgggcgcttcgcaacacacaaggaaattattagcgaatgtcgaaatggctgatgtcaccatggctcccgcggctgatatgtttgaaatgggtgtcaaactacaagtggtaaagcgaggctcaatgtttgctatgcgagccaataaactctatgagctttactctaattatccaagcatcgaagcaattccgaccattgaacgcgagaaagtagagaaacagatttttcgacaaaatctagatcaagtgtgggatattaccaaagctttttttcatgagcgtgacccggacatgttagacagagcactccatgatcctaaacgaaaaatggcacttatttttcgttggtatttaggattgtcatctcgttggtctaatattggtgaaaagggacgtgaaatggactatcaaatatgggctggaccgagtttgggtgcctttaacagttgggtaaaagacagttatttagtcgattaccaacaacgtaatgcagtcgatgtcgcactacatatattaactggtgcggcatatttagaacgtattaatcaattgaaataccaaggtgtgacagtacacaacagtttattaaattatcatccggcacattcttttttatcttaa

SEQ ID NO: 116 - protein, 553 aa, Aliivibrio sp.
  misc_feature: PfaD polypeptide
  misc_feature: SGI Peptide ID NO. 1511516
  misc_feature: Useful for modulating production of PUFA
  misc_feature (9)..(545): NCBI GI: 90408109 Blast Desc: PCNPT3_08200 [Psychromonas sp. CNPT3] gi|90310795|gb|EAS38910.1| PCNPT3_08200 [Psychromonas sp. CNPT3]
  misc_feature (13)..(549): NCBI GI: 325974048 Blast Desc: omega-3 polyunsaturated fatty acid synthase PfaD [Vibrio sp. NSP560] gi|325974058|emb|CCA30309.1| omega-3 polyunsaturated fatty acid synthase PfaD [Photobacterium sp.
  misc_feature (13)..(549): NCBI GI: 218710186 Blast Desc: omega-3 polyunsaturated fatty acid synthase PfaD [Vibrio splendidus LGP32] gi|218323205|emb|CAV19382.1| PfaD, omega-3 polyunsaturated fatty acid synthase [Vibrio splendidus
  misc_feature (14)..(546): NCBI GI: 71281382 Blast Desc: polyunsaturated fatty acid synthase PfaD [Colwellia psychrerythraea 34H] gi|71147122|gb|AAZ27595.1| polyunsaturated fatty acid synthase PfaD [Colwellia psychrerythraea 34H]
  misc_feature (14)..(546): NCBI GI: 149912082 Blast Desc: polyunsaturated fatty acid synthase PfaD [Moritella sp. PE36] gi|149804848|gb|EDM64886.1| polyunsaturated fatty acid synthase PfaD [Moritella sp. PE36]
  misc_feature (14)..(547): NCBI GI: 127513596 Blast Desc: 2-nitropropane dioxygenase [Shewanella loihica PV-4] gi|126638891|gb|ABO24534.1| 2-nitropropane dioxygenase, NPD [Shewanella loihica PV-4]
  misc_feature (14)..(549): NCBI GI: 157376337 Blast Desc: 2-nitropropane dioxygenase [Shewanella sediminis HAW-EB3] gi|157318711|gb|ABV37809.1| 2-nitropropane dioxygenase, NPD [Shewanella sediminis HAW-EB3]
  misc_feature (17)..(548): NCBI GI: 119945398 Blast Desc: pfaD gene product [Psychromonas ingrahamii 37] gi|119864002|gb|ABM03479.1| polyunsaturated fatty acid synthase PfaD [Psychromonas ingrahamii 37]
  misc_feature (20)..(547): NCBI GI: 119774249 Blast Desc: omega-3 polyunsaturated fatty acid synthase PfaD [Shewanella amazonensis SB2B] gi|119766749|gb|ABL99319.1| omega-3 polyunsaturated fatty acid synthase PfaD [Shewanella amazonensis
  misc_feature (36)..(546): NCBI GI: 6691657 Blast Desc: protein product [Moritella marina]
  misc_feature (98)..(373): Pfam Id: PF03060 Pfam Desc: Nitronate monooxygenase
MTQATNKAALIEINKQQIDWNWQVAASTLSGDPVSLKNALLATDKPLYLAKMNNHIAVTHQLMSHQDNSPTDVSSTSILPVLAFAQAIKAEELGSADFKKAHGVKYAYHGGAMANGIASVELVIALGQAGFLCSFGAAGLIPDVIEDSIKRIQSALPDGPFAVNLIHAPSEQALESGAVERFLKLGVNTVEASAFLALTEHIVHYRVAGLSQNPDGSIAINNKVIAKISRTEVAERFMSPAPQKFLTKLLAAGKITALQAELALQVPMADDITAEADSGGHTDNRPFLTLLPTIIKQRDQLQEKYNYVTPLRVGAGGGIGTPESALAAFNMGAAYIVLGSVNQACLEAGASQHTRKLLANVEMADVTMAPAADMFEMGVKLQVVKRGSMFAMRANKLYELYSNYPSIEAIPTIEREKVEKQIFRQNLDQVWDITKAFFHERDPDMLDRALHDPKRKMALIFRWYLGLSSRWSNIGEKGREMDYQIWAGPSLGAFNSWVKDSYLVDYQQRNAVDVALHILTGAAYLERINQLKYQGVTVHNSLLNYHPAHSFLS

SEQ ID NO: 117 - DNA, 840 bp, Aliivibrio sp.
  misc_feature: PfaE gene
  misc_feature: SGI cDNA ID NO. 1511510
  misc_feature: Encodes the peptide sequence at SEQ ID NO 118
  misc_feature: Useful for modulating production of PUFA
atgttgcccttacctaacaaggtctactcagtggatacatttatttcaaatttacatgccttaaaaactgatcatattgatttatggtctattgaccctaccaagttgtgtcaacaatcaatcacatttttaactagtctgttaacaacagaagaatctgaaaaactattaaaatataagcataaagaagctcaacatactgccttaattacacgctcattatgccgcttagtcttatcccactatacaaactgttcgcccgccgcattagaatttgtccgtaattcacagggtaaacctgccctagttaataacaacaatgatatacgttttaatctaagccataataatcaactcattattatggctgtatgtgctggggatgaagttggttgtgatattgaagatccgatgcgtaaagttaatatagcaacgataaccaaacgttattttgcaacacaagaacataaacagttaagtgaattaacaggagtggaacaacagcaacaattttttagatgttggacattgaaagaagctttcgttaaagcaacgggtgtagggattagtttgggtttagatacattttattttagctttaccagcaccactacaggtaaccaaagtgatccatcaaaatcagtggctaaaaaaactcaacaattgaatttaaaggataacattgcaatacatttcaattcacattatcccttgagcaaagatgcgccatggcagttttatcacactttttttaaacaacaaaccatgtcaatctgtcgtgcgagtaaacttaatcaaactattatttatcgcgatgcgacttcattacttggcatttaa

SEQ ID NO: 118 - protein, 279 aa, Aliivibrio sp.
  misc_feature: PfaE polypeptide
  misc_feature: SGI Peptide ID NO. 1511510
  misc_feature: Useful for modulating production of PUFA
  misc_feature (1)..(277): NCBI GI: 192358911 Blast Desc: mtaA gene product [Cellvibrio japonicus Ueda107] gi|190685076|gb|ACE82754.1| HetI [Cellvibrio japonicus Ueda107]
  misc_feature (17)..(221): NCBI GI: 90408179 Blast Desc: 4'-phosphopantetheinyl transferase superfamily protein [Psychromonas sp. CNPT3] gi|90310709|gb|EAS38826.1| 4'-phosphopantetheinyl transferase superfamily protein sp. CNPT3]
  misc_feature (20)..(246): NCBI GI: 108759439 Blast Desc: 4'-phosphopantetheinyl transferase [Myxococcus xanthus DK 1622] gi|108463319|gb|ABF88504.1| 4'-phosphopantetheinyl transferase [Myxococcus xanthus DK 1622]
  misc_feature (21)..(268): NCBI GI: 119946351 Blast Desc: 4'-phosphopantetheinyl transferase [Psychromonas ingrahamii 37] gi|119864955|gb|ABM04432.1| 4'-phosphopantetheinyl transferase [Psychromonas ingrahamii 37]
  misc_feature (21)..(271): NCBI GI: 149911207 Blast Desc: 4-phosphopantetheinyl transferase [Moritella sp. PE36] gi|149805734|gb|EDM65732.1| 4-phosphopantetheinyl transferase [Moritella sp. PE36]
  misc_feature (21)..(200): NCBI GI: 112181143 Blast Desc: 4'-phosphopantetheinyl transferase [Moritella marina]
  misc_feature (21)..(203): NCBI GI: 71282200 Blast Desc: 4-phosphopantetheinyl transferase [Colwellia psychrerythraea 34H] gi|71147940|gb|AAZ28413.1| 4-phosphopantetheinyl transferase [Colwellia psychrerythraea 34H]
  misc_feature (21)..(209): NCBI GI: 119476927 Blast Desc: 4-phosphopantetheinyl transferase [marine gamma proteobacterium HTCC2143] gi|119449734|gb|EAW30971.1| 4-phosphopantetheinyl transferase [marine gamma proteobacterium
  misc_feature (21)..(202): NCBI GI: 383456608 Blast Desc: hetI gene product [Corallococcus coralloides DSM 2259] gi|380733042|gb|AFE09044.1| 4-phosphopantetheinyl transferase [Corallococcus coralloides DSM 2259]
  misc_feature (21)..(231): NCBI GI: 84387726 Blast Desc: 4'-phosphopantetheinyl transferase family protein [Vibrio splendidus 12B01] gi|84377409|gb|EAP94276.1| 4'-phosphopantetheinyl transferase family protein [Vibrio 12B01]
  misc_feature (130)..(192): Pfam Id: PF01648 Pfam Desc: 4'-phosphopantetheinyl transferase superfamily
MLPLPNKVYSVDTFISNLHALKTDHIDLWSIDPTKLCQQSITFLTSLLTTEESEKLLKYKHKEAQHTALITRSLCRLVLSHYTNCSPAALEFVRNSQGKPALVNNNNDIRFNLSHNNQLIIMAVCAGDEVGCDIEDPMRKVNIATITKRYFATQEHKQLSELTGVEQQQQFFRCWTLKEAFVKATGVGISLGLDTFYFSFTSTTTGNQSDPSKSVAKKTQQLNLKDNIAIHFNSHYPLSKDAPWQFYHTFFKQQTMSICRASKLNQTIIYRDATSLLGI

SEQ ID NO: 119 - DNA, 8247 bp, Psychromonas arctica
  misc_feature: PfaA gene
  misc_feature: SGI cDNA ID NO. 1531452
  misc_feature: Encodes the peptide sequence at SEQ ID NO 120
  misc_feature: Useful for modulating production of PUFA
atgccattggagaaaataatgtcaaaaaagcaaaccaccaaccctgcgtcagataagcgactcaactctcgcttgcaagaaacgccgattgcaattgttggtatggcttcggtttttgctgaaagtaaaaacctgggacagttttgggatactatcgtcaattctgtgaatggcattcaagatgtgcctgaagatagatgggcaatcgatgattattattctgctgataaaaaagaagcggataaaagttattgtaaacggggtgcttttctacctgaaattgattttgatccaatggaatttggcttaccgcctaacttattagaactaacagacattactcagttaatggctttggtggttgctcgagatgtattagcagatgcgggcgtgagtgatgaaagtagttttgatcgcgataaaatgggcattgtgctaggcgttggtggtggccaaaaacaagggggacaattgatgtctcgcttacaagggcctgtgcttgaaaaagtattaaaagcatcgggtctgagtgaagatgatacgcaagttatcgtcgataaatttaagaaagcttatatcccttgggaggaaaattcatttcctggtatgttaggtaatgtcattgctggacgaattgccaatcgttttaacttcggcggtactaactgcgtggttgatgctgcttgtgcgggctctttatcagccattaaaatggccgtatcagatctattagaatatcgttcagacatgatgttatcgggcggtatttgttgtgataactcgccctttatgtacatgtcattctctaaaacgcccgcgtttactgacggtgattgtattcgtccttttgatgataaatcaaatggtatgatgataggtgaaggtgtgggaatgatcgctttaaaacgtttggaagatgctgaacgtgatggtgaccgtatctattcggttattaaaggtatcggtagttcatcggatggtaaatttaaatctatttatgcgccgcgacctgaaggccaattaaaagcattaaaacgtgcttatcaagatgctgggtttgacccaaaaacctgtggattaattgaagcacatggaacgggcaccaaagccggtgatgcagctgaatttagagggttagagttactatttagtgagaataacgatcaaaaacaacatgttgctctggggtctgttaaatctcaagtcggtcataccaaggcagcagcaggtgcggcaggcttgattaaagcttcattagccttacaccataaagtgttacctgcgaccattaatgttgataaaccaaatcaaaatttagacatcgaaaatacaccgctttatatcaacactgaaaccagaccatggatgcaacgtgctgatggtgcaaaacgtcaagcaggtgttagctcatttggttttggtgggactaattttcacttagtattagaagaatacacacaaagtcaacaaggtgcataccgcttaaatgaggtagcacaaacgttattatttactgcagataataaacaagcattgattaataccttacaaactgagttagcgttattacaagtagacattgaactacaaccttatgcgcttaatcagttgatcctttcttatcctattaagaaagttgctgatcaacaagctcgttgtggttttgttgcaaaagggattgagcaaaccatccaactgttgcaacaaatgatccagaaattaagcattgaccaaagtactgaatggtcaacacctactggactttattaccgagaacagggcatccagacaactggaaaagtagtagctttattttctggtcaaggctctcaatatgtcaatatggggcgcgagttagtttgtcatttcccaagcatgatggcgagtcaagtatcgatagaccaacaatttcatcaagctggtgaaaatagcttatcgcagtttgtatatcctatccctgttttcgatgagcaaaagcgtgctcaacaagagttagcgttaagagcaacacaatatgcccaacctgctattggtagcttctctgttgggttattcaatacttttaaacaagcaggatttaaagctgattttgccgcaggccatagttttggtgagttgaccgctttatgggctgcagatgtattatctgaaactgacttcatgaagcttgcgatggctcgtgggcaagcgatggctgcacctaacagcgatgtgaatgttgacactgaagcgaacaacaaaaagcttaacagtaactatgattcaggaaaaatggcggcagtcattggagatgtaagtgtcattgaatctcacattaagcttattgatggcgtgagcattgctaattacaatgcaaataatcaagccgttattgccggtacaacggcagcaattgaaactgcaacaacgcagttaatggacagtggatttaaggtgattgcattaccggtttcagctgcattccatacgccattagttgagcatgcacagcaaccttttgctgaagcgattgactctgttacttttaataaacctaaaattgccgtttattccaacgcaacaggtcaagcacacagcgaagatcagcagcagattaaatcagcattaaaagatcatattttacaatcagtgcagttcagtaaagaaataaatagcttgtacgatgcaggtggccgaatctttgttgagtttggtcccaaaaatatattaacacgattagttgataatattttaggtgataaaaaagatgtggtgaccattgcaaccaataataacgctaagcagtgttctgatttgcaattacgtttagccgctattcaaatggcagtgcttggccttgagctggacaatatagatccttattctgcagtagctcgtccaacatttgcacctaaaaaatcaccgcttgcaatgaagctgtcgggtgcttcttatgttagtgaaaaaactaaaaaagcatttcaagatgagctaactgatgattggaaagtggcacaagcaacagcgtctgcagatccagaaattaaagaagttattgttgaaaaagtggttgaaaaaatagtagagagggtggtagaaaaaattgtttatgttgatagtcaaggtaagcctttagctgatcaaacaggcgctaatattcaaggccaagatagtcctcaattatctactaatactcctaataataaccaacaactagcttctagtattgaaactagcgtagagcaatttgttaaacatcaatcacaacttttatctgtgcaccaagcttatttagaagggccaaaccagtacgcagatacctttaaaacggtacttgctgcacaagcgggccaacaaaaattgcccgaaggtttagatagaacgttagctatgtaccatgatttccaaacagaaacattacgagtacatgaaacttacttgaataaccaaactgataacatgcaacaaatgttgaacaatgtctcggctgttgaattaggttctgaacagtcaaataatacgctagacaataatgctgtaaacaccacatctaagcgttcatcgaacattacatcaagtatcgcatcaagcattacagcaaataatgcagtggaaaattcatcgaacaagacaaatagttctgctgcaatagcagagtcaaatgacgttgcccgtacgagtccatctcaactggatgttctacaacaattaaatgcaacacaccaaactattcaatctcagcaaactattcaatctcagcaaactaagacatcggctgacttagttaaagtgccagttgtctctgttgatgctcaagcgattgcaaccatcatgctcgaggtcgtggctgataaaactggttatcctactgaaatgttagaactaagcatggacatggaagcggacctaggtattgattcgattaaacgagttgagatattaggggcagtacaagaccaaattactgatttacctgaactagatgctgagcaattatctcaaatgcgcacgttagcagaaattgttacttatatgaacgaagtgatgacaacggttgctgagcctattaagcaaaattttaccaacgcaaccgactctgctgcgcattttgaagcggcaacatcttcaatccttgtcgatatcaacacgattgaaataatcatgctcgaggtcgtggcagataaaacaggatatcctactgagatgctagaacttagtatggacatggaagcggacttgggaattgattcaatcaaacgtgttgaaatcttaggtgcagtgcaagatgaaattagtgacttgcccgagttagatgcagagcagttatctcaaatgcgcacgttagcagaaattgtcacttacatgaatcaagtcatgacatcggttactggccaagttagtcctgtcattcaggttgatatcgacgtgattgagaaagttatgttgacggtcgttgctgataaaaccggttatccaacagagatgttggaattaggcatggatatggaagctgatttaggcattgattccattaaacgagttgagatattaggggctgtacaagacgaaatttccgatttacctgaattagacgccgagcagttatcgcaaatgcgcacgttagcggaaattgttacttatatgaatcaggtgatggcttctgtaaatgttcatgcgaatagcaacataaagaccaacgatgacgtattgaatgcctcagtgtcaaatgtcgtagattcaactgctatatttacacctaatcataccgatatcaatgcaattgaacgtgtcatgttatcggtagtatctgataaaacaggatacccaactgaaatgctggaattaggcatggatatggaagcagacttaggtattgattccattaaacgtgttgaaattttaggtgcagtgcaagatcaaatcacggatttacccgagttagatgctgagcaattatcgcaaatgcgtacgttagctgaaatcgttaattatatgcattcagtgactacgcctaatacagtcaatacaattgaacctttagcggtcaataataatgacaaagttacgtcgcaaaataatgataatagtactgcttatttgagtattgacttgaatcatattgaaaaagtcatgttcaatgtggtggcggataaaaccggctatccaactgaaatgcttgagctaagtatggacatggaagctgacttagggatcgattcaatcaaacgtgttgaaatattaggcgctgtgcaagatgaaattagtgacttgcctgagttagatgcagaacaattatcacaaatgcgtactctggctgaaattgttaactatatgcattcagtgttgataccaaaccctgcacctggcgcacacggcaatgataatgaggtaaacggtgctgaaaatattgttaaccgtataacagtggatcttaatcatattgagaaagtgatgctgactgtggtggcggataaaaccggttatccagtcgaaatgttggaattaggtatggatatggaagcagacttggggattgattcaatcaaacgtgttgaaattttaggcgcagtgcaagatgaaattaccgaccttcctgaattagatgctgagcagttatcgcaaatgcgtacattagacgaaattattcaatatatgcataccgttcaatcaagctcaattgagttgccgactttaacacctttacatactatcggttctccttcaacggctgcagacaataactttgaacccactgttgtggctaatccttcacctagtgcgacggtagaaataaaaaagcttgctgcacttgagtgtttggactcaagtgttgaaaacaaaaatttactgctggttaatgatggtttagacagcggtgtattaatcgcaaatgaattatctgcattaggttggaatgtaagtgtacttacccctacatgggtggaagaaagtataactaaatgttttgttgatgatattgagcatttaatcttggctgatttaatagaagattcattacaatctttattaaaaagcaaaaacgaatggcaatccatcatctatttgcaccccaaaacggtgattgaggggattaccttttctacggataataagaaagggttacaacttgcttttctattagcgaagttgagtaaactgaatcaaataaataatggtgaccgtgcatcatttttggtattaactcgacaaggtggcgattttgctacccataatgtcgagaaaaaagcagatcttgtgcaaggtggtttatctggtttagtgaaaacgttagctcacgaatgggataatgtattctgtcgtattcttgatgtccctaccaagtacggcgctgcgaaagtagcgaaaatagtactgggtgaacttaacgataaacagatgctaccggttgaagtcggttttaatcaacaggggcgtttatcattagtggctaaaaccactgatagttatgcattagacagcgatagtaagttaggtcatcatgcagtttttctggtcagtggtggcgcaaaaggtgtcacggcgcattgtgtgatcgaaattgctaagcaatatcaatgtaaatttatcttgctaggacgttcaagttatcaagctaaggaagatgattggtcactaagtcatgccactgaaagtgagttaaagaaagctgcaatgcaatatttactcaataacggtgaaaaaccgagtcctaaattgataaaacaattgattgggccggtattagcaaaccgtgaaataacacaaacactacaaagtattgaagcgtttggtggtattgctgagtatgttagcgcagatgtgtgtgatcaagataaccttaaaaaagtcgttcaacctatttgtgacgtatggggacctatcactggtgttatacatggtgcaggcgttttggcagataagtttatagagcaaaaaacactggctgagtttgatcaagtttataacactaaaatacaaggtttagatgcgttattagcttgttgtgagttaagtaaattgcaacacttagttttattttcctctgcagctggcttctatggtaaccctgggcaatcagactatgctattgccaatgaaattcttaataaagctgcttatcgctttaaagctttatatccagcggcacaagtgcttagttttaactggggaccttgggacggcggcatggtaacacctgagctgaaacgtatgtttgatgagcgtggtgtgtacattattcctattcaatcaggggcggtgttattagccagtgaattggcggccaacagtaatcgttgtgtacagatcgtggtgggcactgatatgtcgggtagtggtgctgaagttgatactgaatctgagcatttgcagaacagtgcagtgaataaagtgaatgaagcagtgactcccttaacgcatcgggttacaaaatcctttaatcacgggaatagtttattcattgctgaccataaaattgatggacaacaggtattaccgactgtttgtgcaatggcgtggatgcgctcaacttgcgaagcgttatatcctgattattgttatcaaagtcttgagcactttaaattattaaaaggtattgtttttgatgggcaagaagctaaaaaatatgtgatcgatactaaaatagttgctgagtctgatgcatctgttgcgattgaagtggttgtgagtagtgaaaaagaatccgctaaaccattttttcattatcgtgctgttattaatttacttaaatctgctgtcaataccaatgcagagcaaataatgtatcaaggcattcttccgcaacgtgttaaaaaacaatctccggaagctaaagccttatattcagatggcagtttatttcatggtaaaagtttacagggtattaaatacgttcatcaattagatgagtctggattactaattgaatgtgctattgaatctacttctgttgctgcccaaggggaatttacactcgccgataataacgttttagcgaatgatttggtgtatcaagccctattagtttggacgagtaaaataatgaatgccggtagtttgcctactagcacgcaacagtggcagttattccgtgatgttaaagtaggtgaagacttctttatcaaactgaacattatcaagcaatcaggacaatctgtgcttggcgatgttttgttaattgatcaggaaaatcgtattattagtaaaattacagcggctgaagtgacctgtagtgcaagtttacgtgatttatttaaggctagcgcttaa

SEQ ID NO: 120 - protein, 2748 aa, Psychromonas arctica
  misc_feature: PfaA polypeptide
  misc_feature: SGI Peptide ID NO. 1531452
  misc_feature: Useful for modulating production of PUFA
  misc_feature (7)..(1451): NCBI GI: 354566585 Blast Desc: polyketide-type polyunsaturated fatty acid synthase PfaA [Fischerella sp. JSC-11] gi|353545601|gb|EHC15052.1| polyketide-type polyunsaturated fatty acid synthase PfaA sp.
  misc_feature (8)..(1146): NCBI GI: 15488031 Blast Desc: AF409100_7 omega-3 polyunsaturated fatty acid synthase PfaA [Photobacterium profundum SS9]
  misc_feature (8)..(1146): NCBI GI: 325974032 Blast Desc: omega-3 polyunsaturated fatty acid synthase PfaA [Shewanella sp. MAR441]
  misc_feature (8)..(1146): NCBI GI: 54308653 Blast Desc: omega-3 polyunsaturated fatty acid synthase PfaA [Photobacterium profundum SS9] gi|46913082|emb|CAG19871.1| omega-3 polyunsaturated fatty acid synthase PfaA [Photobacterium
  misc_feature (8)..(1146): NCBI GI: 325974052 Blast Desc: omega-3 polyunsaturated fatty acid synthase PfaA [Photobacterium sp. MA665]
  misc_feature (9)..(1451): NCBI GI: 75908804 Blast Desc: beta-ketoacyl synthase [Anabaena variabilis ATCC 29413] gi|75702529|gb|ABA22205.1| Beta-ketoacyl synthase [Anabaena variabilis ATCC 29413]
  misc_feature (21)..(1454): NCBI GI: 186681757 Blast Desc: beta-ketoacyl synthase [Nostoc punctiforme PCC 73102] gi|186464209|gb|ACC80010.1| beta-ketoacyl synthase [Nostoc punctiforme PCC 73102]
  misc_feature (28)..(307): Pfam Id: PF00109 Pfam Desc: Beta-ketoacyl synthase, N-terminal domain
  misc_feature (315)..(433): Pfam Id: PF02801 Pfam Desc: Beta-ketoacyl synthase, C-terminal domain
  misc_feature (604)..(921): Pfam Id: PF00698 Pfam Desc: Acyl transferase domain
  misc_feature (1272)..(1337): Pfam Id: PF00550 Pfam Desc: Phosphopantetheine attachment site
  misc_feature (1378)..(2744): NCBI GI: 15488031 Blast Desc: AF409100_7 omega-3 polyunsaturated fatty acid synthase PfaA [Photobacterium profundum SS9]
  misc_feature (1378)..(2744): NCBI GI: 325974032 Blast Desc: omega-3 polyunsaturated fatty acid synthase PfaA [Shewanella sp. MAR441]
  misc_feature (1378)..(2744): NCBI GI: 54308653 Blast Desc: omega-3 polyunsaturated fatty acid synthase PfaA [Photobacterium profundum SS9] gi|46913082|emb|CAG19871.1| omega-3 polyunsaturated fatty acid synthase PfaA [Photobacterium
  misc_feature (1382)..(1447): Pfam Id: PF00550 Pfam Desc: Phosphopantetheine attachment site
  misc_feature (1475)..(1540): Pfam Id: PF00550 Pfam Desc: Phosphopantetheine attachment site
  misc_feature (1592)..(1657): Pfam Id: PF00550 Pfam Desc: Phosphopantetheine attachment site
  misc_feature (1706)..(1770): Pfam Id: PF00550 Pfam Desc: Phosphopantetheine attachment site
  misc_feature (1812)..(1877): Pfam Id: PF00550 Pfam Desc: Phosphopantetheine attachment site
  misc_feature (2161)..(2387): Pfam Id: PF08659 Pfam Desc: KR domain
  misc_feature (2245)..(2367): Pfam Id: PF00106 Pfam Desc: short chain dehydrogenase
MPLEKIMSKKQTTNPASDKRLNSRLQETPIAIVGMASVFAESKNLGQFWDTIVNSVNGIQDVPEDRWAIDDYYSADKKEADKSYCKRGAFLPEIDFDPMEFGLPPNLLELTDITQLMALVVARDVLADAGVSDESSFDRDKMGIVLGVGGGQKQGGQLMSRLQGPVLEKVLKASGLSEDDTQVIVDKFKKAYIPWEENSFPGMLGNVIAGRIANRFNFGGTNCVVDAACAGSLSAIKMAVSDLLEYRSDMMLSGGICCDNSPFMYMSFSKTPAFTDGDCIRPFDDKSNGMMIGEGVGMIALKRLEDAERDGDRIYSVIKGIGSSSDGKFKSIYAPRPEGQLKALKRAYQDAGFDPKTCGLIEAHGTGTKAGDAAEFRGLELLFSENNDQKQHVALGSVKSQVGHTKAAAGAAGLIKASLALHHKVLPATINVDKPNQNLDIENTPLYINTETRPWMQRADGAKRQAGVSSFGFGGTNFHLVLEEYTQSQQGAYRLNEVAQTLLFTADNKQALINTLQTELALLQVDIELQPYALNQLILSYPIKKVADQQARCGFVAKGIEQTIQLLQQMIQKLSIDQSTEWSTPTGLYYREQGIQTTGKVVALFSGQGSQYVNMGRELVCHFPSMMASQVSIDQQFHQAGENSLSQFVYPIPVFDEQKRAQQELALRATQYAQPAIGSFSVGLFNTFKQAGFKADFAAGHSFGELTALWAADVLSETDFMKLAMARGQAMAAPNSDVNVDTEANNKKLNSNYDSGKMAAVIGDVSVIESHIKLIDGVSIANYNANNQAVIAGTTAAIETATTQLMDSGFKVIALPVSAAFHTPLVEHAQQPFAEAIDSVTFNKPKIAVYSNATGQAHSEDQQQIKSALKDHILQSVQFSKEINSLYDAGGRIFVEFGPKNILTRLVDNILGDKKDVVTIATNNNAKQCSDLQLRLAAIQMAVLGLELDNIDPYSAVARPTFAPKKSPLAMKLSGASYVSEKTKKAFQDELTDDWKVAQATASADPEIKEVIVEKVVEKIVERVVEKIVYVDSQGKPLADQTGANIQGQDSPQLSTNTPNNNQQLASSIETSVEQFVKHQSQLLSVHQAYLEGPNQYADTFKTVLAAQAGQQKLPEGLDRTLAMYHDFQTETLRVHETYLNNQTDNMQQMLNNVSAVELGSEQSNNTLDNNAVNTTSKRSSNITSSIASSITANNAVENSSNKTNSSAAIAESNDVARTSPSQLDVLQQLNATHQTIQSQQTIQSQQTKTSADLVKVPVVSVDAQAIATIMLEVVADKTGYPTEMLELSMDMEADLGIDSIKRVEILGAVQDQITDLPELDAEQLSQMRTLAEIVTYMNEVMTTVAEPIKQNFTNATDSAAHFEAATSSILVDINTIEIIMLEVVADKTGYPTEMLELSMDMEADLGIDSIKRVEILGAVQDEISDLPELDAEQLSQMRTLAEIVTYMNQVMTSVTGQVSPVIQVDIDVIEKVMLTVVADKTGYPTEMLELGMDMEADLGIDSIKRVEILGAVQDEISDLPELDAEQLSQMRTLAEIVTYMNQVMASVNVHANSNIKTNDDVLNASVSNVVDSTAIFTPNHTDINAIERVMLSVVSDKTGYPTEMLELGMDMEADLGIDSIKRVEILGAVQDQITDLPELDAEQLSQMRTLAEIVNYMHSVTTPNTVNTIEPLAVNNNDKVTSQNNDNSTAYLSIDLNHIEKVMFNVVADKTGYPTEMLELSMDMEADLGIDSIKRVEILGAVQDEISDLPELDAEQLSQMRTLAEIVNYMHSVLIPNPAPGAHGNDNEVNGAENIVNRITVDLNHIEKVMLTVVADKTGYPVEMLELGMDMEADLGIDSIKRVEILGAVQDEITDLPELDAEQLSQMRTLDEIIQYMHTVQSSSIELPTLTPLHTIGSPSTAADNNFEPTVVANPSPSATVEIKKLAALECLDSSVENKNLLLVNDGLDSGVLIANELSALGWNVSVLTPTWVEESITKCFVDDIEHLILADLIEDSLQSLLKSKNEWQSIIYLHPKTVIEGITFSTDNKKGLQLAFLLAKLSKLNQINNGDRASFLVLTRQGGDFATHNVEKKADLVQGGLSGLVKTLAHEWDNVFCRILDVPTKYGAAKVAKIVLGELNDKQMLPVEVGFNQQGRLSLVAKTTDSYALDSDSKLGHHAVFLVSGGAKGVTAHCVIEIAKQYQCKFILLGRSSYQAKEDDWSLSHATESELKKAAMQYLLNNGEKPSPKLIKQLIGPVLANREITQTLQSIEAFGGIAEYVSADVCDQDNLKKVVQPICDVWGPITGVIHGAGVLADKFIEQKTLAEFDQVYNTKIQGLDALLACCELSKLQHLVLFSSAAGFYGNPGQSDYAIANEILNKAAYRFKALYPAAQVLSFNWGPWDGGMVTPELKRMFDERGVYIIPIQSGAVLLASELAANSNRCVQIVVGTDMSGSGAEVDTESEHLQNSAVNKVNEAVTPLTHRVTKSFNHGNSLFIADHKIDGQQVLPTVCAMAWMRSTCEALYPDYCYQSLEHFKLLKGIVFDGQEAKKYVIDTKIVAESDASVAIEVVVSSEKESAKPFFHYRAVINLLKSAVNTNAEQIMYQGILPQRVKKQSPEAKALYSDGSLFHGKSLQGIKYVHQLDESGLLIECAIESTSVAAQGEFTLADNNVLANDLVYQALLVWTSKIMNAGSLPTSTQQWQLFRDVKVGEDFFIKLNIIKQSGQSVLGDVLLIDQENRIISKITAAEVTCSASLRDLFKASA

SEQ ID NO: 121 - DNA, 2889 bp, Psychromonas arctica
  misc_feature: PfaB polypeptide
  misc_feature: SGI cDNA ID NO. 1531453
  misc_feature: Encodes the peptide sequence at SEQ ID NO 122
  misc_feature: Useful for modulating production of PUFA
atgcttgcagtgatcggtttaggggtacgttttgcatcagttaatgatactgatgcattcgattatcatctttacaataatgaatcgatctcgcttttacggtctgctaatccacaacaactagtggatgatgcaaagcaggtgattaaacagttagtcacagttaatcatttattagcgtcagatgttcatttagtgatagtcgatgagattgatggtaataatggtgatcaagttcaggcaacgtcgcaacaatcttctcttgaacacaagccatcactctctgagcaaattggcttagagaccgatgtttttagtgtaacccctgttttatcaactacacaagcattacgaacagctcaacacctctgctctgaaacaacgtctgaagatagagcattagagcgaaaagccgttattattctctctgtgaatcaacaggctaatgatggtgtagctgcgctattagtgtgtgataaaaccttatataacactcctttgttgagcgagcctgcagttaatagcccttcacggcaattttcttcgtgtcattgttatgcggaaattaatgcaatctcttacaagccattaacgggtcaacaagctgccgtcgaggaggggatgagtcagcatatacaagattttatatcgactcatcagctgcaggacattgagtctgtctttactggtcagtcgtttgctgactctcagcatcgcgttactcgaagtgaacatcaacaaagctggttaagtgcttttcaatctttatctgttgaagatgatagattccatctcaaaggtattaacaaacataaagatactattaataataaagcagcaagtcctgaaaaatcgactcaactaacaacagtagaatgtgttaacaccgattcggctaattttgatgcgttattatcattagttgctgctgtattgtgtttggatcaacgttatcgtttggggtgtaaacaaagtattgttccgatgcctgctgatcgatcagttaaggatgaaaattctgcttctaaagctgacaacgttaaagaagaaaactttcttaaagaaagtagtgttaaagaaaactgtgttaaagaaagcaatattgagaatgatcgttttgtggaatggcagcaatcgccattttattatttacctcactccactagttatttaagcacacaacacactaatccccgtcaggttattgttagccatatccaccatataagtaaaagtgtaagtaagaatgtaagtaatgttgagcagactaaacaagctcaaacaagtgacacctcaataccgatgacggctaaattaaactctatgcatgagttaattagtgtgtctgcagcgactaataaaaaaaatggaacattaacagtagttaacggatttttggctcaacagcctttgaagcctgttattttttgtgcgccaaacatcaaacaattaacatatcggttaaagcaagtattacttcagtcaacagctactttaccttcaaagaagcgcggtacttttattgattttgttacacaacaaaacagtttatcttctgatttcaacacgctcaccgatgctaaaactgactataacgctaagtcttattattgtgttgtattattagcctcttctttttcaacgttaaacgagcaaattgaattagcgttatctggagtcgtaactgcgcatcaaaataataaaccgtggaaaacgccagttggcagttatttttgcggacaagctataaccgcatcgaaacaacttaaaccagctagttttatctacccaggcgtaggtgctttatatgtcaacatgggcaaagatctattgcgtttatttccgcagtgttggcaaactttgtcgatgatcagtgatgatctcgcacataacctgcaagataatttaatgacacctcgtttagtccatgaaacagattttaagatgtccgtagcattagaaaagtcgttacgcgcagagttggcgaatattgctgaagcaggtgttagttatgcttgcttattaacggccatattccaacagcaactaggtataaaagcgaccagtgcagccggttatagtatgggggaggtgagtatgtttgctgcccttgattgctggcaaacaccacagttaatgagccaacgatttagagaaagtcacattttcactgaacagctatctggccctctaaaacgactacaaagcatttcacaaacaagcttcaataatgaccaatgggaatcgtatcatctcaaagcggggatcttagacgttgaatcagtgattgatggcttccctggcgtttatatcaccattattaatacgcctgagagtctagtaattgctggtgatcctaaacaatgtctagcattagctaaatgtttaaacttacgcgctattgcattgaatgtacccaatattattcactgtgaactcgctaaaagtgaatatcaaaacatgctgcgattgtattcattagcgatcaaacaaaaagtaagttgccaactgttctctagttcttgttatttacccgtacctgttacggagaaagcgattacggtgagtattagtagatgtttaaccgagttggttgattttccacgcttgataaacaaaatagccgccactggtgaacatgtttttattgagatgggggcggggaaatcattgagtacttggattgaacgtattttaaaaaacaatccaaagccgatcacttgtttatctgttaatcagaaaaatttagatgattatagtgctattttaaaaaccattggcccattgttaagccttggttatcctattaatttagagcctttttttaatgggtcattaatacgtccggttaaaaaagtgtctgcttcagtaccagtttcagtattatag

SEQ ID NO: 122 - protein, 962 aa, Psychromonas arctica
  misc_feature: PfaB polypeptide
  misc_feature: SGI Peptide ID NO. 1531453
  misc_feature: Useful for modulating production of PUFA
  misc_feature (2)..(948): NCBI GI: 90408111 Blast Desc: heterocyst glycolipid synthase [Psychromonas sp. CNPT3] gi|90310797|gb|EAS38912.1| heterocyst glycolipid synthase [Psychromonas sp. CNPT3]
  misc_feature (285)..(950): NCBI GI: 119945396 Blast Desc: polyunsaturated fatty acid synthase PfaB [Psychromonas ingrahamii 37] gi|119864000|gb|ABM03477.1| polyunsaturated fatty acid synthase PfaB [Psychromonas ingrahamii 37]
  misc_feature (375)..(942): NCBI GI: 389800868 Blast Desc: Short-chain dehydrogenase/reductase [Microcystis aeruginosa PCC 9807]
  misc_feature (463)..(955): NCBI GI: 71279011 Blast Desc: polyunsaturated fatty acid synthase PfaB [Colwellia psychrerythraea 34H] gi|71144751|gb|AAZ25224.1| polyunsaturated fatty acid synthase PfaB [Colwellia psychrerythraea 34H]
  misc_feature (480)..(944): Pfam Id: PF00698 Pfam Desc: Acyl transferase domain
  misc_feature (527)..(939): NCBI GI: 6691655 Blast Desc: protein product [Moritella marina]
  misc_feature (527)..(899): NCBI GI: 149909574 Blast Desc: polyunsaturated fatty acid synthase PfaB [Moritella sp. PE36] gi|149807278|gb|EDM67231.1| polyunsaturated fatty acid synthase PfaB [Moritella sp. PE36]
  misc_feature (532)..(942): NCBI GI: 75910946 Blast Desc: beta-ketoacyl synthase [Anabaena variabilis ATCC 29413] gi|75704671|gb|ABA24347.1| Beta-ketoacyl synthase [Anabaena variabilis ATCC 29413]
  misc_feature (532)..(942): NCBI GI: 17229135 Blast Desc: [Nostoc sp. PCC 7120] gi|17135463|dbj|BAB78009.1| all1643 [Nostoc sp. PCC 7120]
  misc_feature (537)..(938): NCBI GI: 37521526 Blast Desc: glycolipid synthase [Gloeobacter violaceus PCC 7421] gi|35212523|dbj|BAC89898.1| gll1957 [Gloeobacter violaceus PCC 7421]
  misc_feature (537)..(943): NCBI GI: 354568593 Blast Desc: PfaB family protein [Fischerella sp. JSC-11] gi|353539847|gb|EHC09327.1| PfaB family protein [Fischerella sp. JSC-11]
MLAVIGLGVRFASVNDTDAFDYHLYNNESISLLRSANPQQLVDDAKQVIKQLVTVNHLLASDVHLVIVDEIDGNNGDQVQATSQQSSLEHKPSLSEQIGLETDVFSVTPVLSTTQALRTAQHLCSETTSEDRALERKAVIILSVNQQANDGVAALLVCDKTLYNTPLLSEPAVNSPSRQFSSCHCYAEINAISYKPLTGQQAAVEEGMSQHIQDFISTHQLQDIESVFTGQSFADSQHRVTRSEHQQSWLSAFQSLSVEDDRFHLKGINKHKDTINNKAASPEKSTQLTTVECVNTDSANFDALLSLVAAVLCLDQRYRLGCKQSIVPMPADRSVKDENSASKADNVKEENFLKESSVKENCVKESNIENDRFVEWQQSPFYYLPHSTSYLSTQHTNPRQVIVSHIHHISKSVSKNVSNVEQTKQAQTSDTSIPMTAKLNSMHELISVSAATNKKNGTLTVVNGFLAQQPLKPVIFCAPNIKQLTYRLKQVLLQSTATLPSKKRGTFIDFVTQQNSLSSDFNTLTDAKTDYNAKSYYCVVLLASSFSTLNEQIELALSGVVTAHQNNKPWKTPVGSYFCGQAITASKQLKPASFIYPGVGALYVNMGKDLLRLFPQCWQTLSMISDDLAHNLQDNLMTPRLVHETDFKMSVALEKSLRAELANIAEAGVSYACLLTAIFQQQLGIKATSAAGYSMGEVSMFAALDCWQTPQLMSQRFRESHIFTEQLSGPLKRLQSISQTSFNNDQWESYHLKAGILDVESVIDGFPGVYITIINTPESLVIAGDPKQCLALAKCLNLRAIALNVPNIIHCELAKSEYQNMLRLYSLAIKQKVSCQLFSSSCYLPVPVTEKAITVSISRCLTELVDFPRLINKIAATGEHVFIEMGAGKSLSTWIERILKNNPKPITCLSVNQKNLDDYSAILKTIGPLLSLGYPINLEPFFNGSLIRPVKKVSASVPVSVL

SEQ ID NO: 123 - DNA, 6054 bp, Psychromonas arctica
  misc_feature: PfaC gene
  misc_feature: SGI cDNA ID NO. 1531455
  misc_feature: Encodes the peptide sequence at SEQ ID NO 124
  misc_feature: Useful for modulating production of PUFA
atggaaaacatcgccattgtgggtattgctaatttatttccaggatcaagtgcgcctgaggaattttggcaacagttgcttaagcagcaagataatagaacctccattactgaaaatgaactaggggttaacccacatgaatacctaggtaaaaagggtgaaaatgataaatattattgcctatatggtggttatattcgtgactttgaatttgatgctactgaatatttaccggctatgccatctacagattcatcatttaatggtcatcgattaacaacaaatgatttaaaccaacttgatgatttgcatcgatggtctctgtacgtcactaaacgtgcgttacaagatgctgggtactggcaaagtgacaagttaagtgattgtggtttgatcttaggtaatttgtcttttcctacaaaacaatcaaatcatttgtttttagatttataccgtgatgtggttgcactcgcattacaacaaacaattgattcaagatttaacctgctcccttttgctaagcccaaaaatgtatctccttataatgcacttgttgctggttatcctgctgcgttattagctgaagttaatggcttaggtggcaactattttgcgttggatgctgcttgtgcctcttcatgctatagcgttaaattagcctgtgattatttacaaacgggcaaagcaaatatgatgttagcaggggctgtctcggctgcggattctttgtttgttaatatggggttttcaattttccaagctttccctgaaaataatcgacatgcaccttttgaccaagactctcaaggcctgtttgccgctcagggggctggcatgatggtgcttaagcgacatagtgatgccatcagtgatggtgaccatgtttatgctgtgatcaaaggtggtgctttaaccaatgatggcaaaggagaatttgtactcagcccgaacagtaaagggcaaatactcgcttatcaagaagcctataaagatgcgcaaattgatccacgtgaaattgattatattgaatgtcatgccacgggaacgcccaaaggtgataaagtcgaattaagttcaatggaacaattctttagtcaatacgaccataaaccgctattaggctctgcaaaatctaatctagggcatttgttaacagctgccggtatgcctgcaatgactaaagctatttatgccctcaatgaaaaaatgatccctgcaaccatcaatgttgataatgctattaatactaaacaaggttatttttcagcacaacaaataccaactcagaatgttgcgtggccgaaaaagtcagatttctttgacgctgaacatcaaaatactgcaggcgtgagtgtatttggttttgggggcagtaatgcgcatctagttttacaagcaggagatactcccaaagcagaaaatactaatcgacttaatgatgttcaaagtcttgcgattgttgggttagattgtcattttggttcgattgatagtgttttgagttatcaacagcttttgaatagtgaaaaagattgttttgtcgatttaccaacgcaacgttggcaaggtattgagaagcagttaccggtgttaaacaaactagggctaacaaaagcgccgaaaggtaattatgttagtgagtttgaaattgacttcttacgttttaaaattcctcctaatgaacaagacagcttaattccgcagcaattattaatgatgaaagtagccgataatgccgcaaaagatgcgaatttaacgccaggtagtaatgtggccgtattagttgctatgggattagagcttgaccttcaccaataccgcggacgagttaatttgcatagccaaattcagcaaagcttattacaacagggtatcgaactaactgcaccgcaactcgcagaactgacggcaatcagtaaacagagtattaatgaccccgcgcaacttaatcaatacaccagctttattggcaatattatggcatcaaggatttctgcattatgggatttcagtggtccagcctttacggtctcgagtgaagaaaattcagtctataaatgtgtagatattgctgataatttattaaaaacaacagcagtcgaagcggttattatagcaagcgttgatttagcgggcagcgtcgaaaatatctctttaagacagcgctttagcaatcgtggctatcactcgaacgctaattatgttgctaatggtgtcgcagaaaatgggcaagtacaatctagtccagaaaaacagttacaatggttagtgggtgaaggtgccggtgcgattgttgttaaagcctcggagaaaaaatcagctgagctgagtcatcagaatgactcaaagactggtgcggaaagtgctgaacaaagcagtgtaaaaagtaactcgaaaaacgtgtatgcaaatattgaggcttgtttatttacacctaataataatcaacaaagtaatcagaatattgttgctcgagctttagtaaaagcgggtatcagcgcagagagaattagccaagtggaagcttttgctgcgggcactgagcagcaattaagcaatgagcataatacgctaactaacatatatcagcaggcaagggttgtttcttctaagcaaaaagtcgggcattgttacaatgcatcaggtatggcgagcctaattgccagtgttttagcacttaaagaaagtgaacacagtgaaacaccccgctatgttgctattaatggtttagggctagacaacagcattgcacatcttattctttcaaacaattatgcgacaaaaccaatcactgcatctgctgtagcatcaaccaaacctggtttaattaaaacggtaaccttaggaggcaaatcaatctttgatgcgatttgccaacaaaaaacgaatcctcttataaaacaagtacaacgatcttttaatgagcagctgaaagtgtctgagcaggcttatttaaacacgttaatcaagatagctgatagcagcaagcatgttgaaatgatgactgaaaataaaccaaaaataacaataaatgctattaatgcagaaaatgcattcaataaagaaaatgcaggtaatgaaatggatagagagcgtagaagcaacgtgttgactcgggtgagtagtacgatagagcaacaaaatcaaacacatcatgcttttttgcgtgcacgatttatggctgaaaagcagatttcatcgttaataaagctacaggcacaagtttcaactgaaagcccactctcttcttcaacgcaagctcagaatgttacgcaagcgcaacatcaaatagaacctttgaacgaaactaatgtttcggctacggctgcaacaaaaagattaggtctactacccattcaaggtcagtatggttatcaatatccagatctgcagcttgtggcgcaatataataaaccttcaaacgttgtttttgataatgcacaattagttgagttcgctgaaggtaaaataggtaatgtatttggtgaacaatatcgtttgattgataactataaacgtcgtgtccgtttaccaacaacggattatttattagttagccgagtcactgaattagacgcagaaatacatcaatacaaaaaatcatccatgttcactgaatacgatattccattagatgctccttttttaattgatgggcaaataccttggtcggtttcagttgaatcaggacaatgtgatttaatgttaatttcttatatcggcattgatttccagaacaaaggggaacgtgtttatcggttattagattgcgaattaacattcttagaagagatggcttttggtggcgaaacactacgttacgaaattcatatcgattcttatgctaaaaatggagagcaattactgtttttcttccattacgattgttttgtcggtgataaaaaagtattaatcatgcgtaatggttgtgcaggatttttcactgatgaagaattggccgacggcaaaggggttattgcgactgcgagtgataaagcgcaatgcgatagtgcagtcaaatcatcatttagtccattaattgctaatactcaaacacaatacgattatcaatcgatgttaaaattagtgcatggtgatataaaaggatgttttggtgatgcttatgatcaacaaggtcgtaatccttcattgaaattttcttctgaaaaattcttgatgattgaacgcatcactcacattgataaaaatggtgggcattggggattaggtttattagaagggcaaaaacaattagatcctgaacattggtatttcccttgccactttaaagatgatcaagtcatggctggatcgttaatgtccgaaggctgtggtcaaatggcaatgttctttatgctgtggctaggcatgaatagtaacgttaataatgcacgcttccaaccgatggcgggtgaagcgcaaacggttcgttgccgagggcaagtaacgccgcaaataaataccttaacttatcgaatggaagtgactgcgattggtatgtcaccgcgtccatttattaaagcaaatattgatattatcttggatcgcaaagtggtcgttgattttaaaaatttatgcatggaaatcaaagaacaagatgacactagtccttttccagtgagcttacctaacaatgtgacaaaggtgaacgtcgcacaacaggctaataagtccgccactatacctgcggctaagtcgactacttttgctaagaatagcgcagtcgaagattcagtgataaaccaaagtactaattatcagattattgatgagagaggaattaaaccattcttacatcctaatcgtcctctaatgcgtgttgaatctgactttaatgcagccactaataaaggggtggtacccattcaacattttgcagcaccttatattagtggtcaaaacagacaacctgataccgtgccattttcaccttggcacatgtttgagtttgcaacgggtaatataagccaatgcttcgggcacgattttgatgtttaccaaggtagaacgcctccacgaacaccctgcggggatttacaggttgttacacaggtcattgacgtgaagggaaagcgtatggactttaaaactccagcgagctgtacaacggaatatgtagtacctgacgatgcatggtattttactaaaaacagctgtagcgattggatgccttattcattattaatggaaattgcactacaacctaatggattcatttcagcctatatggggacaaccttaaagtacccagaaaaagatctctactttcgtaatttagatggtcacggagaaatccttaaacagctcgatttacgaggtaaaaccattgtcaataaatctgttttattgtcgacgagcatggctggtggcgctatcattcaaagttttagttttgatttgagtgtcgatggtgacacgatttaccgtggtggtgctgtgtttggttattttagtgccgaatcattgaccaaccaactagggattgataacggtcaagtgactaaaccgtggtttgttgatcataatattgctgcaaccgatatcaagcagatagatctcaccgatgataagcttaatttattcacagacacagcacagaaaccaaattatcgtctagcaggtggacaattaaattttgttgatagcgttagtattgtagaaggtggcggtgaacacaaattagcttatatttatggagagcgtactatcgatgcaagcgattggttcttccgttatcattttcatcaagatcctgtgatgcctggctcgttaggggttgaagccattatcgagttgttacaatgttatgcgttaacaaatgatttaggtaaacagttcactacccctcgctttatcgccccgacgacaaaagtagtgtggaaatatcgaggacaaattacaccacttaataaaaaaatgaacgtagatgttcacttaaaagaaattatcacgacaacatccgaagttcgcttaataggggatgcaaatctatccaaagatggattacgaatttatcaagtgaaagacattgtcctaagtatcgttgaagcttaa

SEQ ID NO: 124 - protein, 2017 aa, Psychromonas arctica
  misc_feature: PfaC polypeptide
  misc_feature: SGI Peptide ID NO. 1531455
  misc_feature: Useful for modulating production of PUFA
  misc_feature (1)..(2017): NCBI GI: 119945397 Blast Desc: pfaC gene product [Psychromonas ingrahamii 37] gi|119864001|gb|ABM03478.1| polyunsaturated fatty acid synthase PfaC [Psychromonas ingrahamii 37]
  misc_feature (1)..(2017): NCBI GI: 149912083 Blast Desc: polyunsaturated fatty acid synthase PfaC [Moritella sp. PE36] gi|149804849|gb|EDM64887.1| polyunsaturated fatty acid synthase PfaC [Moritella sp. PE36]
  misc_feature (1)..(2017): NCBI GI: 6691656 Blast Desc: protein product [Moritella marina]
  misc_feature (1)..(2016): NCBI GI: 90408110 Blast Desc: multi-domain beta-ketoacyl synthase [Psychromonas sp. CNPT3] gi|90310796|gb|EAS38911.1| multi-domain beta-ketoacyl synthase [Psychromonas sp. CNPT3]
  misc_feature (1)..(2017): NCBI GI: 71278985 Blast Desc: polyunsaturated fatty acid synthase PfaC [Colwellia psychrerythraea 34H] gi|71144725|gb|AAZ25198.1| polyunsaturated fatty acid synthase PfaC [Colwellia psychrerythraea 34H]
  misc_feature (2)..(288): Pfam Id: PF00109 Pfam Desc: Beta-ketoacyl synthase, N-terminal domain
  misc_feature (4)..(2017): NCBI GI: 90413867 Blast Desc: omega-3 polyunsaturated fatty acid synthase PfaC [Photobacterium profundum 3TCK] gi|90325051|gb|EAS41561.1| omega-3 polyunsaturated fatty acid synthase PfaC [Photobacterium
  misc_feature (4)..(2017): NCBI GI: 54308651 Blast Desc: omega-3 polyunsaturated fatty acid synthase PfaC [Photobacterium profundum SS9] gi|46913080|emb|CAG19869.1| omega-3 polyunsaturated fatty acid synthase PfaC [Photobacterium
  misc_feature (4)..(2017): NCBI GI: 15488033 Blast Desc: AF409100_9 omega-3 polyunsaturated fatty acid synthase PfaC [Photobacterium profundum SS9] gi|325974056|emb|CCA30308.1| omega-3 polyunsaturated fatty acid synthase PfaC [Photobacterium
  misc_feature (4)..(2017): NCBI GI: 325974036 Blast Desc: omega-3 polyunsaturated fatty acid synthase PfaC [Shewanella sp. MAR441]
  misc_feature (4)..(2017): NCBI GI: 170725782 Blast Desc: beta-hydroxyacyl-(acyl-carrier-protein) dehydratase FabA/FabZ [Shewanella woodyi ATCC 51908] gi|169811129|gb|ACA85713.1| dehydratase FabA/FabZ [Shewanella
  misc_feature (296)..(411): Pfam Id: PF02801 Pfam Desc: Beta-ketoacyl synthase, C-terminal domain
  misc_feature (484)..(770): Pfam Id: PF00109 Pfam Desc: Beta-ketoacyl synthase, N-terminal domain
  misc_feature (812)..(896): Pfam Id: PF02801 Pfam Desc: Beta-ketoacyl synthase, C-terminal domain
  misc_feature (1389)..(1522): Pfam Id: PF07977 Pfam Desc: FabA-like domain
  misc_feature (1875)..(2008): Pfam Id: PF07977 Pfam Desc: FabA-like domain
MENIAIVGIANLFPGSSAPEEFWQQLLKQQDNRTSITENELGVNPHEYLGKKGENDKYYCLYGGYIRDFEFDATEYLPAMPSTDSSFNGHRLTTNDLNQLDDLHRWSLYVTKRALQDAGYWQSDKLSDCGLILGNLSFPTKQSNHLFLDLYRDVVALALQQTIDSRFNLLPFAKPKNVSPYNALVAGYPAALLAEVNGLGGNYFALDAACASSCYSVKLACDYLQTGKANMMLAGAVSAADSLFVNMGFSIFQAFPENNRHAPFDQDSQGLFAAQGAGMMVLKRHSDAISDGDHVYAVIKGGALTNDGKGEFVLSPNSKGQILAYQEAYKDAQIDPREIDYIECHATGTPKGDKVELSSMEQFFSQYDHKPLLGSAKSNLGHLLTAAGMPAMTKAIYALNEKMIPATINVDNAINTKQGYFSAQQIPTQNVAWPKKSDFFDAEHQNTAGVSVFGFGGSNAHLVLQAGDTPKAENTNRLNDVQSLAIVGLDCHFGSIDSVLSYQQLLNSEKDCFVDLPTQRWQGIEKQLPVLNKLGLTKAPKGNYVSEFEIDFLRFKIPPNEQDSLIPQQLLMMKVADNAAKDANLTPGSNVAVLVAMGLELDLHQYRGRVNLHSQIQQSLLQQGIELTAPQLAELTAISKQSINDPAQLNQYTSFIGNIMASRISALWDFSGPAFTVSSEENSVYKCVDIADNLLKTTAVEAVIIASVDLAGSVENISLRQRFSNRGYHSNANYVANGVAENGQVQSSPEKQLQWLVGEGAGAIVVKASEKKSAELSHQNDSKTGAESAEQSSVKSNSKNVYANIEACLFTPNNNQQSNQNIVARALVKAGISAERISQVEAFAAGTEQQLSNEHNTLTNIYQQARVVSSKQKVGHCYNASGMASLIASVLALKESEHSETPRYVAINGLGLDNSIAHLILSNNYATKPITASAVASTKPGLIKTVTLGGKSIFDAICQQKTNPLIKQVQRSFNEQLKVSEQAYLNTLIKIADSSKHVEMMTENKPKITINAINAENAFNKENAGNEMDRERRSNVLTRVSSTIEQQNQTHHAFLRARFMAEKQISSLIKLQAQVSTESPLSSSTQAQNVTQAQHQIEPLNETNVSATAATKRLGLLPIQGQYGYQYPDLQLVAQYNKPSNVVFDNAQLVEFAEGKIGNVFGEQYRLIDNYKRRVRLPTTDYLLVSRVTELDAEIHQYKKSSMFTEYDIPLDAPFLIDGQIPWSVSVESGQCDLMLISYIGIDFQNKGERVYRLLDCELTFLEEMAFGGETLRYEIHIDSYAKNGEQLLFFFHYDCFVGDKKVLIMRNGCAGFFTDEELADGKGVIATASDKAQCDSAVKSSFSPLIANTQTQYDYQSMLKLVHGDIKGCFGDAYDQQGRNPSLKFSSEKFLMIERITHIDKNGGHWGLGLLEGQKQLDPEHWYFPCHFKDDQVMAGSLMSEGCGQMAMFFMLWLGMNSNVNNARFQPMAGEAQTVRCRGQVTPQINTLTYRMEVTAIGMSPRPFIKANIDIILDRKVVVDFKNLCMEIKEQDDTSPFPVSLPNNVTKVNVAQQANKSATIPAAKSTTFAKNSAVEDSVINQSTNYQIIDERGIKPFLHPNRPLMRVESDFNAATNKGVVPIQHFAAPYISGQNRQPDTVPFSPWHMFEFATGNISQCFGHDFDVYQGRTPPRTPCGDLQVVTQVIDVKGKRMDFKTPASCTTEYVVPDDAWYFTKNSCSDWMPYSLLMEIALQPNGFISAYMGTTLKYPEKDLYFRNLDGHGEILKQLDLRGKTIVNKSVLLSTSMAGGAIIQSFSFDLSVDGDTIYRGGAVFGYFSAESLTNQLGIDNGQVTKPWFVDHNIAATDIKQIDLTDDKLNLFTDTAQKPNYRLAGGQLNFVDSVSIVEGGGEHKLAYIYGERTIDASDWFFRYHFHQDPVMPGSLGVEAIIELLQCYALTNDLGKQFTTPRFIAPTTKVVWKYRGQITPLNKKMNVDVHLKEIITTTSEVRLIGDANLSKDGLRIYQVKDIVLSIVEA

SEQ ID NO: 125 - DNA, 1656 bp, Psychromonas arctica
  misc_feature: PfaD gene
  misc_feature: SGI cDNA ID NO. 1531456
  misc_feature: Encodes the peptide sequence at SEQ ID NO 126
  misc_feature: Useful for modulating production of PUFA
atgacacaatcaactaataaagcagcacttatcgagatcaataaacagcaaattgattggaattggcaagtcgcagcctcaacattaagcgatgaccctgttagcctaaaaaaagcattattagccactgataagccgttatatttagctaaactgaataatgagattgcagtaactcatcaacttatgagccatcaagaggatgtacaacctgagtcagcttctgttttaccagtactggcttttgctcaatcgattaaagcagaggaacttggttctgcagagtttaaaaaagcacatggcgttaaatatgcctatcacggtggggcgatggcgaatggtattgcctctgtggaattggtaattgcgctaggtaaagctggcttgctatgttcatttggcgctgctggccttattccagacgtcattgaagagtcaattaaacgcattcaagtcgctttacctaacggaccttttgcggttaatttaattcattcccctagcgaaccggcattagagtctggtgctgtagagcgatttttgaaactaggtgttagcaccgttgaagcttccgcatttttagctttaacagaacacattgtacattatagagtcgcaggtctttcacaaaatccagatggcagtattgcgattaaaaataaagtcattgcaaaagtgtctcgtactgaagttgctgaacgttttatgtcacctgcaccgcaaaagtttttaacaaaactacttactgcggggaaaattactgcattacaagcagagctcgcactgcaggtaccaatggctgacgatataacagctgaagctgattctggtgggcacacggataatcgcccctttttaactttgttaccgacaattctaaaacagcgagatcaacttcaagccaagtataactatgtgacaccactgcgtgttggtgcgggtggagggataggaacccccgagtctgcgcttgctgcattcaatatgggcgcagcttatattgtgttaggctctgtcaatcaagcctgtgtagaagcaggggcgtcagaacataccagaaagttattggcgaatatagagatggccgatgtcaccatggcacccgctgcagatatgtttgaaatgggggttaagcttcaagttgtaaaacgtggctcaatgtttgccatgcgtgcgaataaactttatgagttatacagtaactaccctagtatcgaagcaataccggcacttgagcgagagaaagtagagaaacaaatcttccgtcaaaacctcgaccaagtttgggatattaccaaagcctttttccatgagcgtgaccctgacatgttagcaagagcattgaatgacccaaaacgtaaaatggcacttatttttcgttggtatttaggattgtcatctcgttggtctaatattggtgaaaaggggcgtgaaatggactatcaaatatgggctggaccgagtttgggcgcctttaacagttgggtaaaagacagttatttagtcgattaccaacaacgtaatgcagtcgatgtagcactacatttattaactggtgcggcatatttagaacgtatcaatcaactgaaataccaaggtgtgacagtacacaacagtttattaaattatcatccggcacattcttttttatcttaa

SEQ ID NO: 126 - protein, 551 aa, Psychromonas arctica
  misc_feature: PfaD polypeptide
  misc_feature: SGI Peptide ID NO. 1531456
  misc_feature: Useful for modulating production of PUFA
  misc_feature (9)..(543): NCBI GI: 90408109 Blast Desc: PCNPT3_08200 [Psychromonas sp. CNPT3] gi|90310795|gb|EAS38910.1| PCNPT3_08200 [Psychromonas sp. CNPT3]
  misc_feature (14)..(544): NCBI GI: 71281382 Blast Desc: polyunsaturated fatty acid synthase PfaD [Colwellia psychrerythraea 34H] gi|71147122|gb|AAZ27595.1| polyunsaturated fatty acid synthase PfaD [Colwellia psychrerythraea 34H]
  misc_feature (14)..(544): NCBI GI: 149912082 Blast Desc: polyunsaturated fatty acid synthase PfaD [Moritella sp. PE36] gi|149804848|gb|EDM64886.1| polyunsaturated fatty acid synthase PfaD [Moritella sp. PE36]
  misc_feature (14)..(545): NCBI GI: 127513596 Blast Desc: 2-nitropropane dioxygenase [Shewanella loihica PV-4] gi|126638891|gb|ABO24534.1| 2-nitropropane dioxygenase, NPD [Shewanella loihica PV-4]
  misc_feature (17)..(546): NCBI GI: 119945398 Blast Desc: pfaD gene product [Psychromonas ingrahamii 37] gi|119864002|gb|ABM03479.1| polyunsaturated fatty acid synthase PfaD [Psychromonas ingrahamii 37]
  misc_feature (20)..(545): NCBI GI: 119774249 Blast Desc: omega-3 polyunsaturated fatty acid synthase PfaD [Shewanella amazonensis SB2B] gi|119766749|gb|ABL99319.1| omega-3 polyunsaturated fatty acid synthase PfaD [Shewanella amazonensis
  misc_feature (20)..(547): NCBI GI: 167624925 Blast Desc: PfaD family protein [Shewanella halifaxensis HAW-EB4] gi|167354947|gb|ABZ77560.1| PfaD family protein [Shewanella halifaxensis HAW-EB4]
  misc_feature (20)..(547): NCBI GI: 157962729 Blast Desc: PfaD family protein [Shewanella pealeana ATCC 700345] gi|157847729|gb|ABV88228.1| PfaD family protein [Shewanella pealeana ATCC 700345]
  misc_feature (20)..(547): NCBI GI: 212557792 Blast Desc: Polyunsaturated fatty acid synthase PfaD [Shewanella piezotolerans WP3]
  misc_feature (36)..(544): NCBI GI: 6691657 Blast Desc: protein product [Moritella marina]
  misc_feature (96)..(371): Pfam Id: PF03060 Pfam Desc: Nitronate monooxygenase
MTQSTNKAALIEINKQQIDWNWQVAASTLSDDPVSLKKALLATDKPLYLAKLNNEIAVTHQLMSHQEDVQPESASVLPVLAFAQSIKAEELGSAEFKKAHGVKYAYHGGAMANGIASVELVIALGKAGLLCSFGAAGLIPDVIEESIKRIQVALPNGPFAVNLIHSPSEPALESGAVERFLKLGVSTVEASAFLALTEHIVHYRVAGLSQNPDGSIAIKNKVIAKVSRTEVAERFMSPAPQKFLTKLLTAGKITALQAELALQVPMADDITAEADSGGHTDNRPFLTLLPTILKQRDQLQAKYNYVTPLRVGAGGGIGTPESALAAFNMGAAYIVLGSVNQACVEAGASEHTRKLLANIEMADVTMAPAADMFEMGVKLQVVKRGSMFAMRANKLYELYSNYPSIEAIPALEREKVEKQIFRQNLDQVWDITKAFFHERDPDMLARALNDPKRKMALIFRWYLGLSSRWSNIGEKGREMDYQIWAGPSLGAFNSWVKDSYLVDYQQRNAVDVALHLLTGAAYLERINQLKYQGVTVHNSLLNYHPAHSFLS

SEQ ID NO: 127 - DNA, 810 bp, Psychromonas arctica
  misc_feature: PfaE gene
  misc_feature: SGI cDNA ID NO. 1528502
  misc_feature: Encodes the peptide sequence at SEQ ID NO 128
  misc_feature: Useful for modulating production of PUFA
gtggatacttttacttcaaatttatataccttaaaaactgatcatattgatttatggtctattgaccctacccagttgtctgaacaatcaatcacgtttttaactagtctgctgacaaaagaagaatatgaaaaattattaaaatataagcataaagtggctcaacatactgccttaattacacgctcattatgtcgcttagtcttatctcactatacaaatagttcacccattgcattacaatttgtccgtaattcacagggaaaaccaacactgattaataacaacaatgatatacgttttaacctaagccataataatcagctcattattatggcagtatgtgttggcgatgaagttggttgtgatattgaaaatccactgcgtaaagttaatattccgacgataactaaacgttattttgcagcacaagaacatcaacagttaagtaaattaactggaatggaacaacagcaacaatttttcagatgttggacattgaaagaagccttcgtaaaagcaacgggtgtagggattagtttaggtttagatacgttttattttagctttacgggcatcgcgcctagtgacaaaagtgaagcatcagaatacgtggcgaacgatattcaacaattgagtttaaaggataacattgcaataaatttcaattcacattatcccttgagtaaagatgcaccgtggcagttttatcacacttcttttaaacaacaaaccatgtctatctgtcgttcaagtaaacttaatcaaactattgtttatcgcgatgcgacttcattacttggcatttaa

SEQ ID NO: 128 - protein, 269 aa, Psychromonas arctica
  misc_feature: PfaE polypeptide
  misc_feature: SGI Peptide ID NO. 1528502
  misc_feature: Useful for modulating production of PUFA
  misc_feature (1)..(225): NCBI GI: 71282200 Blast Desc: 4-phosphopantetheinyl transferase [Colwellia psychrerythraea 34H] gi|71147940|gb|AAZ28413.1| 4-phosphopantetheinyl transferase [Colwellia psychrerythraea 34H]
  misc_feature (5)..(258): NCBI GI: 119946351 Blast Desc: 4'-phosphopantetheinyl transferase [Psychromonas ingrahamii 37] gi|119864955|gb|ABM04432.1| 4'-phosphopantetheinyl transferase [Psychromonas ingrahamii 37]
  misc_feature (5)..(191): NCBI GI: 383456608 Blast Desc: hetI gene product [Corallococcus coralloides DSM 2259] gi|380733042|gb|AFE09044.1| 4-phosphopantetheinyl transferase [Corallococcus coralloides DSM 2259]
  misc_feature (7)..(267): NCBI GI: 192358911 Blast Desc: mtaA gene product [Cellvibrio japonicus Ueda107] gi|190685076|gb|ACE82754.1| HetI [Cellvibrio japonicus Ueda107]
  misc_feature (10)..(261): NCBI GI: 149911207 Blast Desc: 4-phosphopantetheinyl transferase [Moritella sp. PE36] gi|149805734|gb|EDM65732.1| 4-phosphopantetheinyl transferase [Moritella sp. PE36]
  misc_feature (10)..(190): NCBI GI: 112181143 Blast Desc: 4'-phosphopantetheinyl transferase [Moritella marina]
  misc_feature (10)..(197): NCBI GI: 297172891 Blast Desc: phosphopantetheinyl transferase [uncultured gamma proteobacterium HF4000_48E10]
  misc_feature (10)..(236): NCBI GI: 108759439 Blast Desc: 4'-phosphopantetheinyl transferase [Myxococcus xanthus DK 1622] gi|108463319|gb|ABF88504.1| 4'-phosphopantetheinyl transferase [Myxococcus xanthus DK 1622]
  misc_feature (11)..(203): NCBI GI: 119476927 Blast Desc: 4-phosphopantetheinyl transferase [marine gamma proteobacterium HTCC2143] gi|119449734|gb|EAW30971.1| 4-phosphopantetheinyl transferase [marine gamma proteobacterium
  misc_feature (14)..(191): NCBI GI: 90408179 Blast Desc: 4'-phosphopantetheinyl transferase superfamily protein [Psychromonas sp. CNPT3] gi|90310709|gb|EAS38826.1| 4'-phosphopantetheinyl transferase superfamily protein sp. CNPT3]
  misc_feature (120)..(182): Pfam Id: PF01648 Pfam Desc: 4'-phosphopantetheinyl transferase superfamily
MDTFTSNLYTLKTDHIDLWSIDPTQLSEQSITFLTSLLTKEEYEKLLKYKHKVAQHTALITRSLCRLVLSHYTNSSPIALQFVRNSQGKPTLINNNNDIRFNLSHNNQLIIMAVCVGDEVGCDIENPLRKVNIPTITKRYFAAQEHQQLSKLTGMEQQQQFFRCWTLKEAFVKATGVGISLGLDTFYFSFTGIAPSDKSEASEYVANDIQQLSLKDNIAINFNSHYPLSKDAPWQFYHTSFKQQTMSICRSSKLNQTIVYRDATSLLGI

SEQ ID NO: 129 - DNA, 4615 bp, Shewanella sp.
  misc_feature: 5' portion PfaA gene
  misc_feature: SGI cDNA ID NO. 1516387
  misc_feature: Encodes the peptide sequence at SEQ ID NO 130
  misc_feature: Useful for modulating production of PUFA
atgagccaatccagtaataaagataagcgtttaaacaaacgcttaaaagatatgccagtcgcgattgtcggcatggcgagtatttttgctaactcacgttacctaaacaagttttgggatttaatcagcgaaaaaattgatgccattatcgacgttccagaaacccattggaacgctgaagattactacaatgccgataaatcaatggccgataaaacctactgtaaacgcggtggttttttacccgaagtcgatttcaatccaatggaatttggcttgccaccgaatatcctcgaactgacagacacctcacaactcttatctttagtggtcgccaaagaagtgctggccgatgcaggtattgatgcgcagtacgataccgatcgcatcggtattacattaggcgtcggcggtggtcaaaaaatcaatcacagtctcagcggtcgtttacagtatcctatactcaaaaaagtatttaaaaatagtggtctaagcgacgcagacactgagatgttgatcaaaaagtttcaagatcaatatatccactgggaagaaaactcatttcctggctcacttggtaacgtgattgctgggcgtattgctaatcgctttgatttaggcggcatgaattgcgtggttgacgcagcatgtgcaggttctttagcggcgatgcgcatggcgataaccgaattagttgaaggccgcagtgacatgatgatcactggtggtgtgtgtaccgataactcaccatctatgtacatgagcttttcaaaaacaccggcatttaccactaatgacaccattcaacctttcgatatcgattctaaaggcatgatgataggtgaaggcattggcatgatggcgcttaaacgtcttgacgatgctgagcgcgatggtgaccgaatttatgctgttattaaagggattggctcatcatctgatggtaagtttaaaagtatttatgccccgcgcccagaaggccaagctaaagcattaagacgcgcttatgatgatgcgggttttgcaccgcacacggttggcttaattgaagcccatggaacaggcactgccgctggcgatgtggcagagttcaatggtctaaaatcggtgtttaccgaagataatgatacccaacagcacattgctcttggatcagtaaaatcacaagtcggccacactaaatcgaccgctggaaccgctggggtcattaaagttgctttggctttgcatcataaagtgttgccaccgaccattaacgtcagtaaacccaatcctaaattaaacattcaggactcgccgttttatttaaacaccgaaacccgtccatggttacctcgtacagacaatacgccgcgccgcgcgggtattagtgcctttggttttggtggcaccaacttccacattgtgttggaagaataccgccaagaacatgttcgaggcgataaatatcgtcaacgttccgtgccgcaaagtctgttaatccatgctgaaaataaagctgcattacagactcaattaagcgcactgcaagctgaaattagtgctgttgataccacacagcaaaatcgtcaagaaattgtgttggctgattttggtaaacgttttgccttaacgaccatagcccctaaagccgcgcgcataggcttagtggtggcatcattagctgacttaaccattcagctgactcaagcgctggcgcaattgagttcgaatactgccgacagctggcaattgccttctggcaccagttatcgctcagcagcattgattcatcctgaatcggcaagccataaagtggcggcattatttgccggacaaggggcgcagtatctgaacatgggcgtcgatttagcctgtttttatccagaaatgcgtcaacaattgatgcaagcagataaggtatttgcgcaacataaacaaatgccactatcgcaaataatgtaccctaccccggcttttgaagccgaagatattgccgcacaacacgcagcattaaccaatactgccaatgcccaaagtgctattggtgcagtgagcatgggccaatatgcattattgactcaagcaggttttaaagccgatatggtggccggtcatagttttggtgaactgtcagcattatgtgctgcgggggtcattagccaagctgattattatcaattggcctttgctcgtggccaagcaatggcggcaacgcctaaagatcaagatgctggcgtgatgtacgccattattgtccccgctcaagctgttgaccaaggtgttgaaaagcttgaacagtgcattagtgcatttgagggcgtcaaagtggctaattacaatgcaccaacccaactggttattgcaggcccaacagcatcatgtaccttagcggcacaagcaatcaccgctgaacttggctttaaagcaatcgccttgccggtttctggcgcattccacacgccattagtggcccatgcgcaacaaccctttgctgcagccatcgataaggttaaatttgctaagccaaaactaagcctttatgccaatggcacaggtaaagcacatccaaatgatcataaagcaatcaaggcagcatttactgatcatatgctgcagtcagttcgttttagcgagcaattaaccgcaatgtacgacgctggcgcacgagtatttgttgagtttggtcctaaaaacatcctccataaattggttgaggcgaccttaggcaacaaagccgaatcagtcagcatagtgagcttgaacccaaatcctaaaggcaatagcgacactcaactgcgtcaagcagcgtgtcagcttgcggtattagggctggcattaaccgaggttgatccttatcaagcgcccatcgctgaacttgcaaaagtgtcaccgatgaacgtcaagttaactgcgagtaattatattagcgccaccacccaagccaaaatgaacaagtcgctgcaaactggcacagttaccagcaaaacagtagaagtaccggttgagaaaattgtggaaaaaattgtggaaaaagaagtgattaaaactgaatacattgaagtgcctgcaacatcagcaccagcctctgcggttgccgcacctttggcggcaacgacggctgtagcggctaaaccagttagcgcaaatgtgcctgcgtcggccgatagtatcggtgcattttttgctgcgcagcaacaaacggcgcaattacatcagcaatttttagccataccacagcaatatggcgacacgtttgctcatttgatgacagcgcaagcacaaatggcatcatcaggattagccattcctgaaagcttgcaacgttctatggagctgttccaccagcatcaagcacaaacattgcaaagtcacagtcaatttttaacgctgcaagcgcaagcaagtcaagctgcattagccatgttacaagggcaaacaccaatgccagcgtcgacgtcagcaccagtagctgcggcatctatgcagcctgcatttgtgccccaaagccaagttgctcaggccacaacgacgccttcgactgtggtagctcctgttgctgctgctcaagttcaaccagctcaagcggttcaatctcaacagactgccagtaaaccagtccaggctcctgtagctcagcaagtgagttcgcttgcagtttcagccccaacagcaggactatcgcagcaacaagtgttagacactatgctcaatgtggtcgcagataaaaccggttacccaactgaaatgcttgaacttggcatggacatggaagccgatttaggtatcgactctatcaaacgcgtcgaaattttaggcacagtacaagatgagctaccaggtttacctgaactcagcccagaagatttagccgaatgtcgcaccttaggtgaaatcgttagctacatgcaaactaaattacctgctgctaatgcagttagtgttgcgtcctctgcaccagtcgcggcaaacactgcaactgcatcaactggcttaacagctgaaaacgtccagcgcaccatgcttgccgtggttgccgataaaaccggttacccaacagaaatgcttgaacttggcatggacatggaagctgatttaggtatcgactctatcaaacgcgtcgaaattctcggcacagtacaagatgagctgccaggcttacctgagctgagcccagaagatttagccgaatgtcgcaccttaggtgagatcgtcagctacatgcaaaccaaactacctgctgccaatgcagttagtgtagcgtcttctgcaccagtcgcggcaaacactgcaactgcatcaactggcttaacagctgaaaacgtccagtgcacaatgcttgccgtggttgccgataaaaccggttacccaacagaaatgcttgaacttggcatggacatggaagctgacctcggtatcgactccatcaagcgcgtcgaaattctcggcacagtacaagatgagctaccaggtttacctgaactcagcccagaagatttagccgagtgtcgcactttaggcgaaatcgtcagctatatgcaaaccaaactgcctgcggccattacagtggcaccagtagcaaccgtctcttcatctacagcaccgacaacgggcttgagtgctgatacagtattaa

SEQ ID NO: 130 - protein, 1538 aa, Shewanella sp.
  misc_feature: 5' portion of PfaA polypeptide
  misc_feature: N-terminal portion of PfA polypeptide
  misc_feature: SGI Peptide ID NO. 1516387
  misc_feature: Useful for modulating production of PUFA
  misc_feature (1)..(1538): NCBI GI: 114562399 Blast Desc: beta-ketoacyl synthase [Shewanella frigidimarina NCIMB 400] gi|114333692|gb|ABI71074.1| beta-ketoacyl synthase [Shewanella frigidimarina NCIMB 400]
  misc_feature (1)..(1538): NCBI GI: 149675716 Blast Desc: beta-ketoacyl synthase [Shewanella livingstonensis]
  misc_feature (1)..(1538): NCBI GI: 91793978 Blast Desc: beta-ketoacyl synthase [Shewanella denitrificans OS217] gi|91715980|gb|ABE55906.1| beta-ketoacyl synthase [Shewanella denitrificans OS217]
  misc_feature (5)..(1537): NCBI GI: 126173663 Blast Desc: beta-ketoacyl synthase [Shewanella baltica OS155] gi|386340420|ref|YP_006036786.1| polyketide-type polyunsaturated fatty acid synthase PfaA [Shewanella baltica OS117] beta-ketoacyl
  misc_feature (5)..(1537): NCBI GI: 371994232 Blast Desc: polyketide-type polyunsaturated fatty acid synthase PfaA [Shewanella baltica OS183] gi|373948820|ref|ZP_09608781.1| polyketide-type polyunsaturated fatty acid synthase PfaA baltica
  misc_feature (5)..(1537): NCBI GI: 353537327 Blast Desc: polyketide-type polyunsaturated fatty acid synthase PfaA [Shewanella baltica OS625]
  misc_feature (5)..(1537): NCBI GI: 152999951 Blast Desc: erythronolide synthase [Shewanella baltica OS185] gi|151364569|gb|ABS07569.1| Erythronolide synthase [Shewanella baltica OS185]
  misc_feature (5)..(1537): NCBI GI: 160874571 Blast Desc: polyketide-type polyunsaturated fatty acid synthase PfaA [Shewanella baltica OS195] gi|378707821|ref|YP_005272715.1| polyketide-type polyunsaturated fatty acid synthase PfaA baltica
  misc_feature (5)..(1537): NCBI GI: 206570564 Blast Desc: PfaA [Shewanella sp. BR-2]
  misc_feature (5)..(1537): NCBI GI: 217974087 Blast Desc: polyketide-type polyunsaturated fatty acid synthase PfaA [Shewanella baltica OS223] gi|217499222|gb|ACK47415.1| polyketide-type polyunsaturated fatty acid synthase PfaA baltica
  misc_feature (18)..(295): Pfam Id: PF00109 Pfam Desc: Beta-ketoacyl synthase, N-terminal domain
  misc_feature (303)..(420): Pfam Id: PF02801 Pfam Desc: Beta-ketoacyl synthase, C-terminal domain
  misc_feature (602)..(927): Pfam Id: PF00698 Pfam Desc: Acyl transferase domain
  misc_feature (1228)..(1295): Pfam Id: PF00550 Pfam Desc: Phosphopantetheine attachment site
  misc_feature (1334)..(1400): Pfam Id: PF00550 Pfam Desc: Phosphopantetheine attachment site
  misc_feature (1440)..(1505): Pfam Id: PF00550 Pfam Desc: Phosphopantetheine attachment site
MSQSSNKDKRLNKRLKDMPVAIVGMASIFANSRYLNKFWDLISEKIDAIIDVPETHWNAEDYYNADKSMADKTYCKRGGFLPEVDFNPMEFGLPPNILELTDTSQLLSLVVAKEVLADAGIDAQYDTDRIGITLGVGGGQKINHSLSGRLQYPILKKVFKNSGLSDADTEMLIKKFQDQYIHWEENSFPGSLGNVIAGRIANRFDLGGMNCVVDAACAGSLAAMRMAITELVEGRSDMMITGGVCTDNSPSMYMSFSKTPAFTTNDTIQPFDIDSKGMMIGEGIGMMALKRLDDAERDGDRIYAVIKGIGSSSDGKFKSIYAPRPEGQAKALRRAYDDAGFAPHTVGLIEAHGTGTAAGDVAEFNGLKSVFTEDNDTQQHIALGSVKSQVGHTKSTAGTAGVIKVALALHHKVLPPTINVSKPNPKLNIQDSPFYLNTETRPWLPRTDNTPRRAGISAFGFGGTNFHIVLEEYRQEHVRGDKYRQRSVPQSLLIHAENKAALQTQLSALQAEISAVDTTQQNRQEIVLADFGKRFALTTIAPKAARIGLVVASLADLTIQLTQALAQLSSNTADSWQLPSGTSYRSAALIHPESASHKVAALFAGQGAQYLNMGVDLACFYPEMRQQLMQADKVFAQHKQMPLSQIMYPTPAFEAEDIAAQHAALTNTANAQSAIGAVSMGQYALLTQAGFKADMVAGHSFGELSALCAAGVISQADYYQLAFARGQAMAATPKDQDAGVMYAIIVPAQAVDQGVEKLEQCISAFEGVKVANYNAPTQLVIAGPTASCTLAAQAITAELGFKAIALPVSGAFHTPLVAHAQQPFAAAIDKVKFAKPKLSLYANGTGKAHPNDHKAIKAAFTDHMLQSVRFSEQLTAMYDAGARVFVEFGPKNILHKLVEATLGNKAESVSIVSLNPNPKGNSDTQLRQAACQLAVLGLALTEVDPYQAPIAELAKVSPMNVKLTASNYISATTQAKMNKSLQTGTVTSKTVEVPVEKIVEKIVEKEVIKTEYIEVPATSAPASAVAAPLAATTAVAAKPVSANVPASADSIGAFFAAQQQTAQLHQQFLAIPQQYGDTFAHLMTAQAQMASSGLAIPESLQRSMELFHQHQAQTLQSHSQFLTLQAQASQAALAMLQGQTPMPASTSAPVAAASMQPAFVPQSQVAQATTTPSTVVAPVAAAQVQPAQAVQSQQTASKPVQAPVAQQVSSLAVSAPTAGLSQQQVLDTMLNVVADKTGYPTEMLELGMDMEADLGIDSIKRVEILGTVQDELPGLPELSPEDLAECRTLGEIVSYMQTKLPAANAVSVASSAPVAANTATASTGLTAENVQRTMLAVVADKTGYPTEMLELGMDMEADLGIDSIKRVEILGTVQDELPGLPELSPEDLAECRTLGEIVSYMQTKLPAANAVSVASSAPVAANTATASTGLTAENVQCTMLAVVADKTGYPTEMLELGMDMEADLGIDSIKRVEILGTVQDELPGLPELSPEDLAECRTLGEIVSYMQTKLPAAITVAPVATVSSSTAPTTGLSADTVL

SEQ ID NO: 131 - DNA, 3243 bp, Shewanella sp.
  misc_feature: 3' portion of PfaA gene
  misc_feature: SGI cDNA ID NO. 1515425
  misc_feature: Encodes the peptide sequence at SEQ ID NO 132
  misc_feature: Useful for modulating production of PUFA
gatacagtattaagcaccatgatgtcagtcgtcgccgacaaaaccggttacccagctgaaatgcttgaactgagcatggacatggaagcggatttaggcatcgactcaatcaaacgtgttgaaattctaggtacagtgcaagatgagctgccaggcttacctgaactcagcccagaagatttagccgagtgtcgcactttgggcgaaatcgtcagctatatgcaaaccaaactgcctgcagccattacagtggcaccagtagcaaccgtctcttcatctacagcaccgacaacgggcttgagtgctgatacagtattaagcaccatgatgtcagtcgtcgccgacaaaaccggttacccagctgaaatgcttgaactgagcatggacatggaagcggatttaggtatcgactcaatcaaacgggtcgagattttaggcacagtacaagatgagttgcctggcttacctgagcttaacccagaagatttagccgaatgtcgcaccttaggtgaaatcgtcagctacatgcaaacaaaattgcctgcagcgaactcaaccgcgattgcggctgtcgccccagcgtcaacggcaaacaaggttgaggttaacaccgcagcattaccgccacacagcgaggtagcgctaaaaaagttacccgcggcggataaactcgtagattgttattcagcgaaaaactgtattgtcatcacagatgatggccataacgccggtttactcgctgaaaaactcactgcaaagggattaaccgtcgccgttattcgtaacccacaaactatcagcgtagcgcattcagcattaagcagtgatattaaaagctacaccttgagcagcattgatgatgcgaacattgctcaggtgattgccgatattaaagccgacttgggcgcagaacatgccattgcaggttttgttcatttacagccgcaaacgctagtaaataatcacccattaatgtcgtgtactcttgctgcaaaagccgctgtcgacaacgcgttcttatgggctaagcatcttcacccagaatttgctaaaccaacgtcttcgcgtctgtgctactttaccgtgagtcgtttagacggcgggtttggctacttagataatgaccaattagccacagcggaactgaatcaagcggccttgtctgggctgagcaaaaccttaagccatgagtggccacaagtattttgccgcgccttagacattagtaataatattgatgcaacaagctttgccgatgccatcgttgctgagttgtttgatatcgatggtgccaatgcaagcgtagatcgcattaatgaagtggggattagtcagcaaggtcgagtaaccttagtcgcagccaatgccagtgagcagtttgcgccagcaacgcttgatggtaatgacactattttggtcaccggcggcgcaaaaggggtaacgtttgaatgcgccctcaccttagccaaacaatgccaatcacattttgtgttagcaggtcgtagccaacattttggcagcgacttaccggcttgggcacaaggcaagcaagcctctgagttaaaagccgcggccattgcttatattcaatcgcaaggcaataaacccacgccaaaacaaattgatgcattagtgtggccaattagcagcagcctagaaatcgatgctgcattagccgctttcagtaaggtcggcgccagcgcgcaatatgtctcaatggatgtcagcgacgccacagcggtagccgcctgccttaacagcctgacgaatgctaagggcgacccgttaaccattaatggcgttattcacggcgcaggggtgttagccgacaagcatattcaagacaaaaccttggatgaacttaaccgcgtttatcacactaaagtgaccgggcttgcaagtataattaatgcactcgacccacaacagatcaagctgattgccttgttttcatcggctgccggtttctacggaaataccggacaaagcgattatgctatgtcgaatgaaatcctcaataaaaccgcccttaaactggcacacaccttagcgcatgctaaagtaatgagttttaactggggcccttgggatggcggaatggtcagttcggcattaaagaaaatgtttgttgatcgcggtgtttacgtgattccattacaagcaggtgccgagttatttgcccactgtttattaagtcagcaaggcgcacaattgcttattggctctgatatgcaaggttcatcagatcaggataatgctgtaaaaaagcttaatgcggacgctttgcttatcgccaagggttcgctgacgtttgcagctaagacacagttctctgatcttatcagcatgacggtgactcgagtcttaaccccggctgaaatgccttttgttagcgatcattgtattgctggtaatccggtattgccgacagtatgtgccatgcaatggatgcgtgatgcagcacaaaccttatgtcatgtgcctgtcagtattgctgaatataaattgcttaaaggggttatttttgacaccaatgagccacatttgctgcaactggaactaacgcaaactgacgctgggatcaacgcgctgatctcatctcatttgttaaatgagccaagtgcagcaatgaaaccgcaatatcaagcaacattagtgatcaatcgcgccgtcttgactgatgatattgccaagcccgtgattgatacagcgagcctgacaaagtggtcgcatatagcgccgttgagctcaggggttgaactgtatcaaaacggaaccttgtttcatggcccacgtttgcaaggcattaagcaagtgttggcatttgatgatgctcagctcttgtgccaagtgcaattaccgcagattaataccgctgactgtgaacgttttatcccatcatcggcattaggtggcagccaagttttcgcggaagatttgctgctacaagccatgctggtatgggccagacttaaatacggtgcggccagtttaccttcatcaacggctgaatgtgttaccgcttggccatttgccagtggtgataaaggctatattcaactggatgttgttaaacacagcggcagaatgttaatcgctaacgtgagtttataccatcaagatggtcgcttgagttgccaaatgctcaacgctaaagtgactatcagtaaaagtttgaatggggcttttattccacatcaagcggctactggtgtgtctcaccacagcaaggaaacagtgtga

SEQ ID NO: 132 - protein, 1080 aa, Shewanella sp.
  misc_feature: carboxy terminal portion of PfaA polypeptide
  misc_feature: SGI Peptide ID NO. 1515425
  misc_feature: Useful for modulating production of PUFA
  misc_feature (1)..(1080): NCBI GI: 149675716 Blast Desc: beta-ketoacyl synthase [Shewanella livingstonensis]
  misc_feature (1)..(1080): NCBI GI: 114562399 Blast Desc: beta-ketoacyl synthase [Shewanella frigidimarina NCIMB 400] gi|114333692|gb|ABI71074.1| beta-ketoacyl synthase [Shewanella frigidimarina NCIMB 400]
  misc_feature (1)..(1063): NCBI GI: 91793978 Blast Desc: beta-ketoacyl synthase [Shewanella denitrificans OS217] gi|91715980|gb|ABE55906.1| beta-ketoacyl synthase [Shewanella denitrificans OS217]
  misc_feature (1)..(1065): NCBI GI: 84387725 Blast Desc: omega-3 polyunsaturated fatty acid synthase PfaA [Vibrio splendidus 12B01] gi|84377408|gb|EAP94275.1| omega-3 polyunsaturated fatty acid synthase PfaA [Vibrio splendidus
  misc_feature (1)..(1069): NCBI GI: 218710183 Blast Desc: omega-3 polyunsaturated fatty acid synthase PfaA [Vibrio splendidus LGP32] gi|218323202|emb|CAV19379.1| PfaA, omega-3 polyunsaturated fatty acid synthase [Vibrio splendidus
  misc_feature (1)..(1069): NCBI GI: 325974042 Blast Desc: omega-3 polyunsaturated fatty acid synthase PfaA [Vibrio sp. NSP560]
  misc_feature (1)..(1068): NCBI GI: 157962726 Blast Desc: polyketide-type polyunsaturated fatty acid synthase PfaA [Shewanella pealeana ATCC 700345] gi|157847726|gb|ABV88225.1| Polyketide-type polyunsaturated fatty
  misc_feature (3)..(1064): NCBI GI: 90413869 Blast Desc: omega-3 polyunsaturated fatty acid synthase PfaA [Photobacterium profundum 3TCK] gi|90325053|gb|EAS41563.1| omega-3 polyunsaturated fatty acid synthase PfaA [Photobacterium
  misc_feature (3)..(1064): NCBI GI: 15488031 Blast Desc: AF409100_7 omega-3 polyunsaturated fatty acid synthase PfaA [Photobacterium profundum SS9]
  misc_feature (3)..(1064): NCBI GI: 54308653 Blast Desc: omega-3 polyunsaturated fatty acid synthase PfaA [Photobacterium profundum SS9] gi|46913082|emb|CAG19871.1| omega-3 polyunsaturated fatty acid synthase PfaA [Photobacterium
  misc_feature (8)..(73): Pfam Id: PF00550 Pfam Desc: Phosphopantetheine attachment site
  misc_feature (110)..(175): Pfam Id: PF00550 Pfam Desc: Phosphopantetheine attachment site
  misc_feature (470)..(541): Pfam Id: PF00106 Pfam Desc: short chain dehydrogenase
  misc_feature (470)..(698): Pfam Id: PF08659 Pfam Desc: KR domain
  misc_feature (557)..(683): Pfam Id: PF00106 Pfam Desc: short chain dehydrogenase
DTVLSTMMSVVADKTGYPAEMLELSMDMEADLGIDSIKRVEILGTVQDELPGLPELSPEDLAECRTLGEIVSYMQTKLPAAITVAPVATVSSSTAPTTGLSADTVLSTMMSVVADKTGYPAEMLELSMDMEADLGIDSIKRVEILGTVQDELPGLPELNPEDLAECRTLGEIVSYMQTKLPAANSTAIAAVAPASTANKVEVNTAALPPHSEVALKKLPAADKLVDCYSAKNCIVITDDGHNAGLLAEKLTAKGLTVAVIRNPQTISVAHSALSSDIKSYTLSSIDDANIAQVIADIKADLGAEHAIAGFVHLQPQTLVNNHPLMSCTLAAKAAVDNAFLWAKHLHPEFAKPTSSRLCYFTVSRLDGGFGYLDNDQLATAELNQAALSGLSKTLSHEWPQVFCRALDISNNIDATSFADAIVAELFDIDGANASVDRINEVGISQQGRVTLVAANASEQFAPATLDGNDTILVTGGAKGVTFECALTLAKQCQSHFVLAGRSQHFGSDLPAWAQGKQASELKAAAIAYIQSQGNKPTPKQIDALVWPISSSLEIDAALAAFSKVGASAQYVSMDVSDATAVAACLNSLTNAKGDPLTINGVIHGAGVLADKHIQDKTLDELNRVYHTKVTGLASIINALDPQQIKLIALFSSAAGFYGNTGQSDYAMSNEILNKTALKLAHTLAHAKVMSFNWGPWDGGMVSSALKKMFVDRGVYVIPLQAGAELFAHCLLSQQGAQLLIGSDMQGSSDQDNAVKKLNADALLIAKGSLTFAAKTQFSDLISMTVTRVLTPAEMPFVSDHCIAGNPVLPTVCAMQWMRDAAQTLCHVPVSIAEYKLLKGVIFDTNEPHLLQLELTQTDAGINALISSHLLNEPSAAMKPQYQATLVINRAVLTDDIAKPVIDTASLTKWSHIAPLSSGVELYQNGTLFHGPRLQGIKQVLAFDDAQLLCQVQLPQINTADCERFIPSSALGGSQVFAEDLLLQAMLVWARLKYGAASLPSSTAECVTAWPFASGDKGYIQLDVVKHSGRMLIANVSLYHQDGRLSCQMLNAKVTISKSLNGAFIPHQAATGVSHHSKETV

SEQ ID NO: 133 - DNA, 2187 bp, Shewanella sp.
  misc_feature: PfaB gene
  misc_feature: SGI cDNA ID NO. 1515426
  misc_feature: Encodes the peptide sequence at SEQ ID NO 134
  misc_feature: Useful for modulating production of PUFA
gtgacggtattaagcaacatggtgctaaacacgatgagtgagcgtattgcaaagcaacaaactaagcctatgcgtttagctttgttgctttgcaagcctaatattgcctcgattaatgaacacctgatcactgtcgacactcatagtgtcgacggctttgcgttggcgttattgctcgcttgcgaacacctatcgtccaccagcaatgacatggtcaacattggcgatcgattgtggataatgtctgggttaattgcggctaaaaacggtatccatgcgcatgcttatatcaatggtattgcgctgagtaacaaccaaactgaagcggtaacacttgcccttaagcatgcaaaacgtctgcatgctcagccacagatagtcgcgctagatggctgttataattttagtgcaagttctgatggcaatgccactgatgatgcagtgacggatccagctaatgattctagatctgagtcagctcctcatgcaagtgcgccccatacgaatgagatggcacaaacagcactgacggcaatggtcaacctagtcgagtctatcgcgagtcgctgtataccagcccaagacaaggctaacggtcaatattggtttagcgcatttcaccaaagccgagtcgcagctttatgttatccaaccgcatcaggtgttcaggcaatcatccttacccaaggtcgtgcacttatcgccgccaagccgttaatcagtactcaacgtttatggctgccgcttagcgccgcttcattggcgcaattgcacactaagctgatgggcctttcttcgcagttacactcagccattaacgacataagcttactcgagcttatcaaaaccagtttattagattatcaaacagatgcaccgctagccctagtcttaatggcagccgatcgccgcgcattagtacaagaagtcagcgcgatgatgaccataatcgccactcatcagcagcatgatacgaatagtcatacgccgatagaatataaaacgcctgcgggcagttgcttatattcagcgccgctgggtcataatggcttgagctttgtttatcctggcgttggcactgtgtacccaaacatgcttagtcaaataggcctggttttcccagatttgtatgctgaacttgaaaaccaaggtgacatgcaatcgatgttacaaacggactttatctatgcggcagataaaaatcgtgccgcacagatgagcctgagccaattagccattgctggtgttggcgccagttatattttaaccaagttattacagagagagtttgccattgagcctcgttttgctttgggttattccatgggtgaagcggccatgtgggcgagtttaaacgtatggcaaacaccacatagcatgattgcagccacgcaaaacagcagtatttttacccgagatatttctggtgagctccgctgtgttcgccaacaatggcaattagccgatgacgaaaacattgtatggaatagcttcgttactcgagccagcattgacgaactcgcgccccatttagccaattacccacgggcttatattgctattattcagggtgatacctgtgttgttgccgggtgtgaaaacagttgtaaagccttactaaagcaagctggtaaacgcggcattgccgctaatcgcgtcaccgcaatgcacacgcctgcggcattgaacatcagcgaatcagtaaggcaattttatcaacaaccattagtagaaaacttaccaagccaattgcagtttatctccgcagcagagactcagcctgttgtattaacctcacaagccattgcaaaatcgattgccgatactttttgtcatcagctcaattttactcagttaattcttaatgctcgagagcaaggctgtcgactatttgttgaagtaggtgccgatcggcaaactaccaccctaattgacaaaatcaatgcgcagagtagcaatagcgtctcagcgatggcaatggccgtcaatgctaaaggtggcgatgacgtcaccagtttacttaaatgcctagggcaactaattgctcatcgagtgcccatgtcattaagcccttttattcgcagccttgacgctagcattaatacattatcccagcaggcggcattagccgacggctcatccctcatttgttatagtgaaacatcattagaaggagaacctcattga

SEQ ID NO: 134 - protein, 728 aa, Shewanella sp.
  misc_feature: PfaB polypeptide
  misc_feature: SGI Peptide ID NO. 1515426
  misc_feature: Useful for modulating production of PUFA
  misc_feature (1)..(728): NCBI GI: 114562398 Blast Desc: omega-3 polyunsaturated fatty acid synthase PfaB [Shewanella frigidimarina NCIMB 400] gi|114333691|gb|ABI71073.1| omega-3 polyunsaturated fatty acid synthase PfaB [Shewanella 400]
  misc_feature (1)..(728): NCBI GI: 91793979 Blast Desc: omega-3 polyunsaturated fatty acid synthase PfaB [Shewanella denitrificans OS217] gi|91715981|gb|ABE55907.1| omega-3 polyunsaturated fatty acid synthase PfaB [Shewanella
  misc_feature (7)..(728): NCBI GI: 219806606 Blast Desc: omega-3 polyunsaturated fatty acid synthase PfaB [Shewanella livingstonensis]
  misc_feature (16)..(728): NCBI GI: 336310879 Blast Desc: omega-3 polyunsaturated fatty acid synthase subunit, PfaB [Shewanella sp. HN-41] gi|335865559|gb|EGM70575.1| omega-3 polyunsaturated fatty acid synthase subunit, PfaB [Shewanella sp.
  misc_feature (67)..(704): NCBI GI: 371994231 Blast Desc: PfaB family protein [Shewanella baltica OS183] gi|373948819|ref|ZP_09608780.1| PfaB family protein [Shewanella baltica OS183] gi|386325340|ref|YP_006021457.1| PfaB family PfaB
  misc_feature (67)..(712): NCBI GI: 126173662 Blast Desc: PfaB family protein [Shewanella baltica OS155] gi|125996867|gb|ABN60942.1| omega-3 polyunsaturated fatty acid synthase PfaB [Shewanella baltica OS155]
  misc_feature (67)..(715): NCBI GI: 217974088 Blast Desc: PfaB family protein [Shewanella baltica OS223] gi|217499223|gb|ACK47416.1| PfaB family protein [Shewanella baltica OS223]
  misc_feature (67)..(712): NCBI GI: 386340419 Blast Desc: PfaB family protein [Shewanella baltica OS117] gi|334862820|gb|AEH13291.1| PfaB family protein [Shewanella baltica OS117]
  misc_feature (73)..(728): NCBI GI: 160874570 Blast Desc: PfaB family protein [Shewanella baltica OS195] gi|378707820|ref|YP_005272714.1| PfaB family protein [Shewanella baltica OS678] gi|160860092|gb|ABX48626.1| PfaB family protein
  misc_feature (78)..(704): NCBI GI: 386313104 Blast Desc: omega-3 polyunsaturated fatty acid synthase, PfaB [Shewanella putrefaciens 200] gi|319425729|gb|ADV53803.1| omega-3 polyunsaturated fatty acid synthase, PfaB [Shewanella 200]
  misc_feature (353)..(656): Pfam Id: PF00698 Pfam Desc: Acyl transferase domain
MTVLSNMVLNTMSERIAKQQTKPMRLALLLCKPNIASINEHLITVDTHSVDGFALALLLACEHLSSTSNDMVNIGDRLWIMSGLIAAKNGIHAHAYINGIALSNNQTEAVTLALKHAKRLHAQPQIVALDGCYNFSASSDGNATDDAVTDPANDSRSESAPHASAPHTNEMAQTALTAMVNLVESIASRCIPAQDKANGQYWFSAFHQSRVAALCYPTASGVQAIILTQGRALIAAKPLISTQRLWLPLSAASLAQLHTKLMGLSSQLHSAINDISLLELIKTSLLDYQTDAPLALVLMAADRRALVQEVSAMMTIIATHQQHDTNSHTPIEYKTPAGSCLYSAPLGHNGLSFVYPGVGTVYPNMLSQIGLVFPDLYAELENQGDMQSMLQTDFIYAADKNRAAQMSLSQLAIAGVGASYILTKLLQREFAIEPRFALGYSMGEAAMWASLNVWQTPHSMIAATQNSSIFTRDISGELRCVRQQWQLADDENIVWNSFVTRASIDELAPHLANYPRAYIAIIQGDTCVVAGCENSCKALLKQAGKRGIAANRVTAMHTPAALNISESVRQFYQQPLVENLPSQLQFISAAETQPVVLTSQAIAKSIADTFCHQLNFTQLILNAREQGCRLFVEVGADRQTTTLIDKINAQSSNSVSAMAMAVNAKGGDDVTSLLKCLGQLIAHRVPMSLSPFIRSLDASINTLSQQAALADGSSLICYSETSLEGEPH

SEQ ID NO: 135 - DNA, 5910 bp, Shewanella sp.
  misc_feature: PfaC gene
  misc_feature: SGI cDNA ID NO. 1515419
  misc_feature: Encodes the peptide sequence at SEQ ID NO 136
  misc_feature: Useful for modulating production of PUFA
ttgagttctcaagctacccctaaaatagccattgtcggtttagccaatcagtatccagacgcggatactcccgctaaattttggcaaaacttattagacaaaaaagattcacgcagccaaatcagtgccagcaaactcaatgcttcaccgagtgactacttgggtatacaaggcgaatcggaccgtttttattgcgataaaggcggctacattcaagactttcaatttaatcctcaaggttatcgcattgagcccagcgcatttaatggcttagacgatagcttcttgtgggcaaccgacacagcacgtaatgcgttaacagatgccggtattagccttgacgatagcttgcttaaacgcaccggtattgtgatgggaaccttatcattccctacggctaaatctaatgaactgtttgtacctctgtatcacagcgcggtcgaaaaagccttacagaccaagctgcaacagccaaactttagcctacactgtttcaataatagcgttaacaagagttgtgatcagccacaagctaatcatgctgccaccgctcaaccggttaacttaggtaatggtgccattgcccataatgcctcgaaaattgttgccgatgctttaggtttgggcggtacgcagctgagtttagatgcagcctgtgctagctcggtttacgccttaaaactcgcctgtgattacttgcatactggcaaggcagatatgatgttagctggcgctgtgtctggcgcagatccattcttcatcaatatgggattttcaatatttcacgcttatccagaccatggaatttcagcgccctttgatcgtaacagtaaaggcttattcgccggcgaaggtgcgggggtattagtacttaaacgccttgaagacgctgagcgtgatggcgaccatatctatgctttagtcagtggtatcggtttatcaaacgacggtaaaggtcagtttgtgttaagcccaaatagcaaaggccaagtactagcattcgagcgcgcttatcgcgatgcggcagcaatagacccaagtattacccctgccagtattgaagtgattgaatgccatgccacgggaacgccattaggcgataaagtagaattaacctcaatggaacgcttttttgaagataaacttcaaggcagcgcgacgccactgattggttcagccaaatctaatctaggccatttactcaccgcggcaggcatgcctgggatcatgaaaatgatttttgccatgcgccaaggcgtgttgccaccgagtattaatatcagtgccccaatctcatcacctaatggattatttggtcaagcgaccttacccaatgtggtcttgccttggcccgataaagtcggcaataaagcccgtcatgcaggtgtttcggtatttggttttggcggttgtaacgcccatttactgatcgagtcctatcaagatcaggcaggcataaaccatgctgacagtaaacgatctcagcttagtcgcagcaaaatagtcagtacagaaacgccaatgcacattaccggcatggcagcccactttggtcagtgcagcagcatcaatgcattggctgataaaatcatcaataagcaaccactgtttagcccattgcccaatcaacgctggaaaggcttagacaagcaccctgagttattggctcaatatggcatacatcaggtgccacaaggggcgtatattgatcagttcgattttgattttttacgtttcaaagtgccgcctaatgaagatgatcgcctgatatcgcaacaactgttattaatcaaaatagcagatgaagccattgccaatgccaagctaacgcctggcagtaaagtagccgtgttggttgccatggaaaccgaacttgaattacaccaatttcgcggtcgagttaacttacatagccaaatagcgcaaagccttaatgcccaagggatccagttatccagtgctgaatatgccagccttgaagcaattgcgatggacagtgttttagatgccgccaagctaaatcaatataccagctttattggtaacattatggcgtcacggatctcctcattatgggatttcaatggcccggcatttaccatttcagctggtgcacagtcagttaatcgttgtatcgatgtggcgcaaaacttatttgctcttggttcgttacaagagcctttggatgccatcatcatcgccgcggtagatctttccggcagcattgaaaatatgttattcaatactgccaagcttaatgctaagggattaagctcaaccgactggaaagtaggtgaaggcgctggcgcgatagtgctacaacaaactaatgctgcacatcctgagcttgacagctatgccagcataaacagtattgattttgactcattatcacaacgcccggccaacattgcagcagaacttatcgaattaaaccaatcgcctgaatgcatattaacaactcaaggccaacagtttgtccaaggattaactgatgctgcagcggtcaactcagcgccgttattgagtaaagcacaagatattctcggtcacacctttgccgcttctggcatggccagtttactgcacgctttagtacaaagccgccatattgataaatcggccatcaacgccagtgtattcaccagcagcgaaacccaatactcacaggttaatctgtctgtttcggcgccgcagcaacacgcattgcgtactcgtctgagcaacaatttgacgcaacaattagccacaggcaataagttaagcttaattaagcaagttagtttaggtggccgagatatctatcaacatattattgatagctcacttgaaggtctcgacagcattgtggctcaatgcgccaatatcacaacaatggccgacagcaatctagatcaatgtgctgataccacttcagcaaaagctaaaatcattgacacaactaagccaaaaaccacctgtgacagcagccactttagtgtcaatcatagcgagcatatcgccgagtctcttatgtcagaaaacaccgtttcaacagcagagcaacctaaggttgccagtgtgacaagcccgaccataccgccagcacatttaagtgcatttcagcaaaatcaatggttagcgcagcaagcgcacttagcctacttatccagccgagatgcggggttaaaagtcgccgacagtttattacgctcacaattagccggtttcgccggccagcaaatctcttatgtgtcacaggcttcacagcctgctgtaaatgtagatcctatcgcctcagctgctgtacctgtggaattaattcaacctaatcatgcttgtgtgccagcttacaccgcgccgatccccgcggataaaccgtgtatttggaattatgctgatttagtcgagtatgccgaaggcgatatcgctaaggtatttggcccagattatgccattatcgacagctattctcgtcgagtaagactgcccaccacagattacttgttggtgtcgcgcgtcactaaacttgatgcgaccatgaatcaatacaaaccttgttcaatgaccacagaatacgacatcccagtcgatgcaccgtatttagtcgatggtcaaatcccttgggctgtagcagtagaatcgggtcaatgtgatttaatgttgatcagttacttaggcatcgattttgaaaacaagggcgaacgggtttatcgtttattagattgtactttgactttcttagaagatttacctcgtggcggtgacacgctgcgttacgatataaaaatcaataactttgctagcaatggcgatacgttattattctttttctcttacgaatgcttcgtaggcgacaagatgatcctcaaaatggatggcggctgcgcaggcttctttaccgaccaagaactggccgatggtaaaggggttattcaaactgaagatgaaataaaacgtcgtcaacaagtgctcaataatccaaacaaaccgaccttcacgccattactacactgtagccaaacggcatttgattatggccaaattcatcatttactgaccggcgatattggcagctgttttggcggcgaacacgtcgcccaccagctacaaaatggtatgcaaaaatcgctttgttttgcctcagaaaagttcttaatgattgagcgtgttagtcaattacaaactcaaggtggtgcttggggcttaggcttactcgaaggtcataagcatattgcgccagatcattggtatttcccttgtcatttccaaggcgaccaagtgatggccggctcgctaatggcagaaggttgtggtcaactattacagttctatatgatccacattggcatgcatactctcgtcgagaatggccgattccagcctctggaaaacgcctcacaaaaagtccgctgtcgtggccaagtgttaccacaaaccgccgaactgacttatcgcatggaagtgactgaaataggcattcatcctcgcccttacgccaaagctaatattgatattttacttaatggcaaagttgtggtcgatttccaaaacttaggcgtgatgattaaggaagaggctgaatgttcgcgttacccacttatctcgttaaacgcagcaaacactagcactgccgttgattcagacgctagcagtaaagtgattaccagcaaagcgccattaatggcgcaagttccagatttacatgccccgagtaacaagggcgttattccgctaaaacaccttgaagcgcccatcgtaagtgccgattcaaagtatgctaatcgcgtgcctgataccgtaccatttacgccataccacatgttcgaatttgccacaggcgatatcgaaaagtgctttggcccagactttagtatttaccgcggattgatcccgccgcgtacaccctgtggcgatttacagttaaccacgcgcgtcgttgaaattaacggtaagcgcggcgaactgaaaaaaccatcatcgtgtatcgcagagtacgaagtgccggcagatgcttggtactttgcaaaaaacagccatcaagcggtaatgccttactcagtgctaatggaaatttcactacaacctaacggttttatctcaggctatatgggcaccactcttggcttccccgggcaagagctgtttttccgtaatttagatggtagcggtaaattattgcgccatgtggatttacgcggtaaaaccatagtcaatgactcaaagctattatcaaccgtcatcgctggcagtaacattattcaaagcttcacctttgaattaagtgtcgataacgagccgttttatactggtagtgcggtatttggttacttcaaaggtgatgcgctaaagaaccagcttggtattgataatggcaggatcacccagccttggcatatcgataataatgtcgcggcagacattagcgtcaacttactggataaacagtcgcgagtatttaatgcaccagcaagccaaccgcattatcgccttgcgggcggccagcttaactttatcgataaagccgaaattgttaacactggtggcaaatacggtaagggctatcttgctgcgtcacgcactattgacccaagtgattggttcttccaatttcacttccatcaagatccggttatgccgggttcattaggtgttgaagccgtgatcgagttgatgcaaacttacgccatctctacagacttaggtaaaggtttcaccaatccgaaatttggtcatatattgtcggatattaagtggaaatatcgcggtcaaattaatccgcttaacaaacaaatgtcacttgatgtgcatatcagtgcagtaaaagatgaagacggaaagcgcatcataataggcgatgcaaacctcagtaaagatggtctacgcatttatgaagtcaaagacatcgcaatctgtattgaagaagcttag

SEQ ID NO: 136 - protein, 1969 aa, Shewanella sp.
  misc_feature: PfaC polypeptide
  misc_feature: SGI Peptide ID NO. 1515419
  misc_feature: Useful for modulating production of PUFA
  misc_feature (1)..(1969): NCBI GI: 114562397 Blast Desc: Beta-hydroxyacyl-(acyl-carrier-protein) dehydratase, FabA/FabZ [Shewanella frigidimarina NCIMB 400] gi|114333690|gb|ABI71072.1| dehydratase, FabA/FabZ [Shewanella
  misc_feature (1)..(1969): NCBI GI: 91793980 Blast Desc: 3-hydroxyacyl-ACP dehydratase [Shewanella denitrificans OS217] gi|91715982|gb|ABE55908.1| Beta-hydroxyacyl-(acyl-carrier-protein) dehydratase, FabA/FabZ
  misc_feature (1)..(1969): NCBI GI: 126173661 Blast Desc: Beta-hydroxyacyl-(acyl-carrier-protein) dehydratase FabA/FabZ [Shewanella baltica OS155] gi|386340418|ref|YP_006036784.1| synthase I., dehydratase baltica
  misc_feature (1)..(1969): NCBI GI: 336310878 Blast Desc: omega-3 polyunsaturated fatty acid synthase subunit, PfaC [Shewanella sp. HN-41] gi|335865558|gb|EGM70574.1| omega-3 polyunsaturated fatty acid synthase subunit, PfaC [Shewanella sp.
  misc_feature (2)..(1969): NCBI GI: 120599576 Blast Desc: Beta-hydroxyacyl-(acyl-carrier-protein) dehydratase, FabA/FabZ [Shewanella sp. W3-18-1] gi|146292427|ref|YP_001182851.1| dehydratase, FabA/FabZ CN-32]
  misc_feature (2)..(1969): NCBI GI: 152999949 Blast Desc: beta-hydroxyacyl-(acyl-carrier-protein) dehydratase FabA/FabZ [Shewanella baltica OS185] gi|151364567|gb|ABS07567.1| Beta-hydroxyacyl-(acyl-carrier-protein) dehydratase FabA/FabZ
  misc_feature (2)..(1969): NCBI GI: 160874569 Blast Desc: beta-hydroxyacyl-(acyl-carrier-protein) dehydratase FabA/FabZ [Shewanella baltica OS195] gi|378707819|ref|YP_005272713.1| dehydratase FabA/FabZ baltica
  misc_feature (2)..(1969): NCBI GI: 206570566 Blast Desc: PfaC [Shewanella sp. BR-2]
  misc_feature (8)..(297): Pfam Id: PF00109 Pfam Desc: Beta-ketoacyl synthase, N-terminal domain
  misc_feature (12)..(1969): NCBI GI: 386313103 Blast Desc: multi-domain beta-ketoacyl synthase, PfaC [Shewanella putrefaciens 200] gi|319425728|gb|ADV53802.1| multi-domain beta-ketoacyl synthase, PfaC [Shewanella putrefaciens 200]
  misc_feature (125)..(1969): NCBI GI: 219806608 Blast Desc: Beta-hydroxyacyl-(acyl-carrier-protein) dehydratase, FabA/FabZ [Shewanella livingstonensis]
  misc_feature (305)..(427): Pfam Id: PF02801 Pfam Desc: Beta-ketoacyl synthase, C-terminal domain
  misc_feature (507)..(775): Pfam Id: PF00109 Pfam Desc: Beta-ketoacyl synthase, N-terminal domain
  misc_feature (1375)..(1509): Pfam Id: PF07977 Pfam Desc: FabA-like domain
  misc_feature (1827)..(1960): Pfam Id: PF07977 Pfam Desc: FabA-like domain
MSSQATPKIAIVGLANQYPDADTPAKFWQNLLDKKDSRSQISASKLNASPSDYLGIQGESDRFYCDKGGYIQDFQFNPQGYRIEPSAFNGLDDSFLWATDTARNALTDAGISLDDSLLKRTGIVMGTLSFPTAKSNELFVPLYHSAVEKALQTKLQQPNFSLHCFNNSVNKSCDQPQANHAATAQPVNLGNGAIAHNASKIVADALGLGGTQLSLDAACASSVYALKLACDYLHTGKADMMLAGAVSGADPFFINMGFSIFHAYPDHGISAPFDRNSKGLFAGEGAGVLVLKRLEDAERDGDHIYALVSGIGLSNDGKGQFVLSPNSKGQVLAFERAYRDAAAIDPSITPASIEVIECHATGTPLGDKVELTSMERFFEDKLQGSATPLIGSAKSNLGHLLTAAGMPGIMKMIFAMRQGVLPPSINISAPISSPNGLFGQATLPNVVLPWPDKVGNKARHAGVSVFGFGGCNAHLLIESYQDQAGINHADSKRSQLSRSKIVSTETPMHITGMAAHFGQCSSINALADKIINKQPLFSPLPNQRWKGLDKHPELLAQYGIHQVPQGAYIDQFDFDFLRFKVPPNEDDRLISQQLLLIKIADEAIANAKLTPGSKVAVLVAMETELELHQFRGRVNLHSQIAQSLNAQGIQLSSAEYASLEAIAMDSVLDAAKLNQYTSFIGNIMASRISSLWDFNGPAFTISAGAQSVNRCIDVAQNLFALGSLQEPLDAIIIAAVDLSGSIENMLFNTAKLNAKGLSSTDWKVGEGAGAIVLQQTNAAHPELDSYASINSIDFDSLSQRPANIAAELIELNQSPECILTTQGQQFVQGLTDAAAVNSAPLLSKAQDILGHTFAASGMASLLHALVQSRHIDKSAINASVFTSSETQYSQVNLSVSAPQQHALRTRLSNNLTQQLATGNKLSLIKQVSLGGRDIYQHIIDSSLEGLDSIVAQCANITTMADSNLDQCADTTSAKAKIIDTTKPKTTCDSSHFSVNHSEHIAESLMSENTVSTAEQPKVASVTSPTIPPAHLSAFQQNQWLAQQAHLAYLSSRDAGLKVADSLLRSQLAGFAGQQISYVSQASQPAVNVDPIASAAVPVELIQPNHACVPAYTAPIPADKPCIWNYADLVEYAEGDIAKVFGPDYAIIDSYSRRVRLPTTDYLLVSRVTKLDATMNQYKPCSMTTEYDIPVDAPYLVDGQIPWAVAVESGQCDLMLISYLGIDFENKGERVYRLLDCTLTFLEDLPRGGDTLRYDIKINNFASNGDTLLFFFSYECFVGDKMILKMDGGCAGFFTDQELADGKGVIQTEDEIKRRQQVLNNPNKPTFTPLLHCSQTAFDYGQIHHLLTGDIGSCFGGEHVAHQLQNGMQKSLCFASEKFLMIERVSQLQTQGGAWGLGLLEGHKHIAPDHWYFPCHFQGDQVMAGSLMAEGCGQLLQFYMIHIGMHTLVENGRFQPLENASQKVRCRGQVLPQTAELTYRMEVTEIGIHPRPYAKANIDILLNGKVVVDFQNLGVMIKEEAECSRYPLISLNAANTSTAVDSDASSKVITSKAPLMAQVPDLHAPSNKGVIPLKHLEAPIVSADSKYANRVPDTVPFTPYHMFEFATGDIEKCFGPDFSIYRGLIPPRTPCGDLQLTTRVVEINGKRGELKKPSSCIAEYEVPADAWYFAKNSHQAVMPYSVLMEISLQPNGFISGYMGTTLGFPGQELFFRNLDGSGKLLRHVDLRGKTIVNDSKLLSTVIAGSNIIQSFTFELSVDNEPFYTGSAVFGYFKGDALKNQLGIDNGRITQPWHIDNNVAADISVNLLDKQSRVFNAPASQPHYRLAGGQLNFIDKAEIVNTGGKYGKGYLAASRTIDPSDWFFQFHFHQDPVMPGSLGVEAVIELMQTYAISTDLGKGFTNPKFGHILSDIKWKYRGQINPLNKQMSLDVHISAVKDEDGKRIIIGDANLSKDGLRIYEVKDIAICIEEA

SEQ ID NO: 137 - DNA, 1629 bp, Shewanella sp.
  misc_feature: PfaD gene
  misc_feature: SGI cDNA ID NO. 1515420
  misc_feature: Encodes the peptide sequence at SEQ ID NO 138
  misc_feature: Useful for modulating production of PUFA
atgacaacacaagtgcacaacgaaaagctttctccttggccatggcaagttagccagcaacacgttagctttgatcaaactgggatgaacaaaaagctcaaagatttatcacaagcgtgttatttggttaacgacgcgcaacaaggcttaggcgtggcgcaacaagctcaagtggtgaccgacgcagttaatgcacctaacactttacctgtaagcgcttttggacctgcactgggtacccaaagtttaggcgacagtaattttcgccgcgtgcatggggtaaaatatgcctattatgctggcgcgatggctaatggcatttcctcggaagaattggttatcgcgttaggccaagcgggtattttatgttcgtttggcgcagctgggttaattccatctcgagttgaacaagcgataaaccgcatccaagcagcgctgcccaatgggccatatgcgtttaacttaatccacagcccaagtgagccagcgcttgagcgtggcagtgttgagctatttttaaaacataaagtacgcacggttgaggcctcagcctttttaggcttaaccccacaaatagtctattaccgcgcagcaggcttaagccgcgatgctcatggtgatattcaaatcgacaataaagtgattgctaaaattagccgcaccgaagtcgcgattaagtttatgcaaccagcacctgttaaaatgctgcaacaacttgttgatgatggcctcattagcgcagagcaaatggaactggcacaacttgtaccaatggcggatgatattaccgctgaagccgactctggtggccataccgacaaccgtccattagtgacgttactgcccactattttggcgttaaaagatgaagtgcaagcgcaatacaaatacaaaacacctatccgtgttggcgcgggtggcggtgtgggtacacccgatgccgcgctggctacgtttcatatgggcgcagcctatattgttaccggatcaattaaccaagcctgcgtggaagcgggggctagcgagcatacgcgcaaattactagcgacgaccgaaatggccgatgtgactatggcacccgctgctgatatgttcgaaatgggggtcaagttacaagtggtcaagcgtggcacattattcccgatgcgagccaacaagttgtatgaaatttacagccgttatgactcaatagaagcgattccaagtgacgaacgcgaaaaacttgaaaaacaagtattccgctcaagcctagatgatatttgggctggtactgtcgcgcattttaatgagcgcgacccaaagcaaattgaacgtgcgaaagacaatccaaaacgtaaaatggccttgattttccgttggtatcttggcttatcaagccgctggtcaaactctggtgaagtcggccgtgaaatggattatcaaatttgggcaggcccagcattaggcgcatttaacgcttgggctaaaaatagttatttagatgactacagccaacgtcatgcagtagacttagcgaaacatttaatgcatggggcagcttatttggcccgagtgaatttattgacggcgcaaggcgttagccttccagtagcattacagcgttggcgcccaattgatcaaataaaatag

SEQ ID NO: 138 - protein, 542 aa, Shewanella sp.
  misc_feature: PfaD polypeptide
  misc_feature: SGI Peptide ID NO. 1515420
  misc_feature: Useful for modulating production of PUFA
  misc_feature (1)..(542): NCBI GI: 219806610 Blast Desc: omega-3 polyunsaturated fatty acid synthase PfaD [Shewanella livingstonensis]
  misc_feature (1)..(542): NCBI GI: 114562396 Blast Desc: 2-nitropropane dioxygenase [Shewanella frigidimarina NCIMB 400] gi|114333689|gb|ABI71071.1| 2-nitropropane dioxygenase, NPD [Shewanella frigidimarina NCIMB 400]
  misc_feature (1)..(541): NCBI GI: 91793981 Blast Desc: Sden_2630 [Shewanella denitrificans OS217] gi|91715983|gb|ABE55909.1| conserved [Shewanella denitrificans OS217]
  misc_feature (6)..(541): NCBI GI: 371994229 Blast Desc: PfaD family protein [Shewanella baltica OS183] gi|373948817|ref|ZP_09608778.1| PfaD family protein [Shewanella baltica OS183] gi|386325342|ref|YP_006021459.1| PfaD family PfaD
  misc_feature (6)..(541): NCBI GI: 152999948 Blast Desc: PfaD family protein [Shewanella baltica OS185] gi|160874568|ref|YP_001553884.1| PfaD family protein [Shewanella baltica OS195] gi|378707818|ref|YP_005272712.1| PfaD family PfaD
  misc_feature (6)..(540): NCBI GI: 336310877 Blast Desc: enoyl-[acyl-carrier-protein] reductase [FMN] , inferred for PFA pathway [Shewanella sp. HN-41] gi|335865557|gb|EGM70573.1| enoyl-[acyl-carrier-protein] [FMN] ,
  misc_feature (6)..(541): NCBI GI: 120599577 Blast Desc: 2-nitropropane dioxygenase [Shewanella sp. W3-18-1] gi|146292426|ref|YP_001182850.1| 2-nitropropane dioxygenase [Shewanella putrefaciens CN-32] gi|120559670|gb|ABM25597.1| NPD
  misc_feature (6)..(541): NCBI GI: 386313102 Blast Desc: omega-3 polyunsaturated fatty acid synthase subunit, PfaD [Shewanella putrefaciens 200] gi|319425727|gb|ADV53801.1| omega-3 polyunsaturated fatty acid synthase subunit, PfaD 200]
  misc_feature (6)..(541): NCBI GI: 126173660 Blast Desc: PfaD family protein [Shewanella baltica OS155] gi|386340417|ref|YP_006036783.1| PfaD family protein [Shewanella baltica OS117] gi|125996865|gb|ABN60940.1| 2-nitropropane NPD
  misc_feature (6)..(541): NCBI GI: 217974090 Blast Desc: PfaD family protein [Shewanella baltica OS223] gi|217499225|gb|ACK47418.1| PfaD family protein [Shewanella baltica OS223]
  misc_feature (88)..(363): Pfam Id: PF03060 Pfam Desc: Nitronate monooxygenase
MTTQVHNEKLSPWPWQVSQQHVSFDQTGMNKKLKDLSQACYLVNDAQQGLGVAQQAQVVTDAVNAPNTLPVSAFGPALGTQSLGDSNFRRVHGVKYAYYAGAMANGISSEELVIALGQAGILCSFGAAGLIPSRVEQAINRIQAALPNGPYAFNLIHSPSEPALERGSVELFLKHKVRTVEASAFLGLTPQIVYYRAAGLSRDAHGDIQIDNKVIAKISRTEVAIKFMQPAPVKMLQQLVDDGLISAEQMELAQLVPMADDITAEADSGGHTDNRPLVTLLPTILALKDEVQAQYKYKTPIRVGAGGGVGTPDAALATFHMGAAYIVTGSINQACVEAGASEHTRKLLATTEMADVTMAPAADMFEMGVKLQVVKRGTLFPMRANKLYEIYSRYDSIEAIPSDEREKLEKQVFRSSLDDIWAGTVAHFNERDPKQIERAKDNPKRKMALIFRWYLGLSSRWSNSGEVGREMDYQIWAGPALGAFNAWAKNSYLDDYSQRHAVDLAKHLMHGAAYLARVNLLTAQGVSLPVALQRWRPIDQIK

SEQ ID NO: 139 - DNA, 888 bp, Shewanella sp.
  misc_feature: PfaE gene
  misc_feature: SGI cDNA ID NO. 1516370
  misc_feature: Encodes the peptide sequence at SEQ ID NO 140
  misc_feature: Useful for modulating production of PUFA
atgtttaatagagccttgtttgttttaatgtctgttacatctcctataaactcatctcagccgctttttcagccacatatttattttgtgccactggatggcgcgctttgtgctgcagattatgaggctggtttagccttaaattggttaaccgatgacgaggttgctaaggttagtcgttacataagtcaatcggcgcgcaatactggtttacaagtgcgtttagcgcttcgggctattatgtcacttcatagtgatttaaaaccttttgagtggcgttttagctatggtgctaaaggtaaaccggcgcttagcgaagacttattggttcaaactgggctgcattttaatttgagccatagcggcgattggctaatgatcggcattgtcagtaataagcaagcatatgccgctgaaacagccttgtcatttggtgttgatattgagcgtgaacgcggcagtaccaaaatagaagctattttgaatcactacttttctgctgttgaaatagaagatttgatggcattgccgcttgagttacaacgccaacgtttttttgatttatgggcgttaaaagaggcttttattaaagcaacaggcaaagggttggcgcagtcgttaacctcttttgggtttacattcgctgctaatagcgtgtttgaagctgttaataagcaatttcctactatcgcagcgagtgactatatccatttttcagcgctcgattatcacgaaccgcaatggcagttttactttggccgattaagcccatattaccgcttcagcgtgtgtattggtgatatgcaatctcagtctttgctgcatataaaagcgccaacgatgtcgataatttcgttggcgcaattaataccttcttcacacgactag

SEQ ID NO: 140 - protein, 295 aa, Shewanella sp.
  misc_feature: PfaE polypeptide
  misc_feature: SGI Peptide ID NO. 1516370
  misc_feature: Useful for modulating production of PUFA
  misc_feature (12)..(289): NCBI GI: 206570562 Blast Desc: 4'-phosphopantetheinyl transferase [Shewanella sp. BR-2]
  misc_feature (12)..(266): NCBI GI: 126173665 Blast Desc: 4'-phosphopantetheinyl transferase [Shewanella baltica OS155] gi|386340422|ref|YP_006036788.1| 4'-phosphopantetheinyl transferase [Shewanella baltica OS117] 4'-phosphopantetheinyl
  misc_feature (12)..(289): NCBI GI: 152999953 Blast Desc: 4'-phosphopantetheinyl transferase [Shewanella baltica OS185] gi|151364571|gb|ABS07571.1| 4'-phosphopantetheinyl transferase [Shewanella baltica OS185]
  misc_feature (12)..(289): NCBI GI: 160874573 Blast Desc: 4'-phosphopantetheinyl transferase [Shewanella baltica OS195] gi|378707823|ref|YP_005272717.1| 4'-phosphopantetheinyl transferase [Shewanella baltica OS678] 4'-phosphopantetheinyl
  misc_feature (12)..(289): NCBI GI: 217974085 Blast Desc: 4'-phosphopantetheinyl transferase [Shewanella baltica OS223] gi|217499220|gb|ACK47413.1| 4'-phosphopantetheinyl transferase [Shewanella baltica OS223]
  misc_feature (12)..(289): NCBI GI: 371994234 Blast Desc: 4'-phosphopantetheinyl transferase [Shewanella baltica OS183] gi|373948822|ref|ZP_09608783.1| 4'-phosphopantetheinyl transferase [Shewanella baltica OS183] 4'-phosphopantetheinyl
  misc_feature (19)..(266): NCBI GI: 18542421 Blast Desc: AF467805_1 phosphopantetheinyl transferase [Shewanella sp. SC2A]
  misc_feature (19)..(266): NCBI GI: 149675712 Blast Desc: 4'-phosphopantetheinyl transferase [Shewanella livingstonensis]
  misc_feature (19)..(266): NCBI GI: 114562423 Blast Desc: 4'-phosphopantetheinyl transferase [Shewanella frigidimarina NCIMB 400] gi|114333716|gb|ABI71098.1| 4'-phosphopantetheinyl transferase [Shewanella frigidimarina 400]
  misc_feature (27)..(286): NCBI GI: 157962724 Blast Desc: 4'-phosphopantetheinyl transferase [Shewanella pealeana ATCC 700345] gi|157847724|gb|ABV88223.1| 4'-phosphopantetheinyl transferase [Shewanella pealeana ATCC
  misc_feature (145)..(207): Pfam Id: PF01648 Pfam Desc: 4'-phosphopantetheinyl transferase superfamily
MFNRALFVLMSVTSPINSSQPLFQPHIYFVPLDGALCAADYEAGLALNWLTDDEVAKVSRYISQSARNTGLQVRLALRAIMSLHSDLKPFEWRFSYGAKGKPALSEDLLVQTGLHFNLSHSGDWLMIGIVSNKQAYAAETALSFGVDIERERGSTKIEAILNHYFSAVEIEDLMALPLELQRQRFFDLWALKEAFIKATGKGLAQSLTSFGFTFAANSVFEAVNKQFPTIAASDYIHFSALDYHEPQWQFYFGRLSPYYRFSVCIGDMQSQSLLHIKAPTMSIISLAQLIPSSHD

SEQ ID NO: 141 - DNA, 7851 bp, Shewanella sp.
  misc_feature: PfaA gene
  misc_feature: SGI cDNA ID NO. 1513783
  misc_feature: Encodes the peptide sequence at SEQ ID NO 142
  misc_feature: Useful for modulating production of PUFA
atgagccaatccagtaataaagataagcgtttaaacaaacgcttaaaagatatgccagtcgcgattgtcggcatggcgagtatttttgctaactcacgttacataaacaagttttgggatttaatcagcgaaaaaattgatgccattatcgacgttccagaaacccattggaacgctgaagattactacaatgccgataaatcaatggccgataaaacctactgtaaacgcggtggttttttacccgaagtcgatttcaatccaatggaatttggcttgccaccgaatatcctcgaactgacagacacctcacaactcttatctttagtggtcgccaaagaagtgctggccgatgcaggtattgatgcgcagtacgataccgatcgcatcggtattacattaggcgtcggcggtggtcaaaaaatcaatcacagtctcagcggtcgtttacagtaccctatactcaaaaaagtatttaaaaatagtggtctaagcgacgcagacactgagatgttgatcaaaaagtttcaagatcaatatatccactgggaagaaaactcatttccaggctcacttggtaacgtgattgctgggcgtattgctaatcgctttgatttaggcggcatgaattgcgtggttgacgcagcatgtgcaggttctttagcggcgatgcgcatggcgataaccgaattagttgaaggccgcagtgacatgatgatcaccggtggtgtgtgtaccgataactcgccatctatgtacatgagcttttcaaaaacaccggcatttaccactaatgacaccattcaacctttcgatatcgattctaaaggcatgatgataggtgaaggcattggcatgatggcgcttaaacgtcttgacgatgctgagcgcgatggtgaccgaatttatgctgttattaaagggattggctcatcatctgatggcaagtttaaaagtatttatgccccgcgcccagaaggccaggctaaagcattaagacgcgcttatgatgatgcgggttttgcaccgcacacggttggcttaattgaagcccatggaacaggcactgccgctggcgatgtggcagagttcaatggtctaaaatcggtgtttaccgaagataatgatacccaacagcacattgctcttggatcagtaaaatcacaagtcggccacactaaatcgaccgctggaaccgctggggtcattaaagttgctttggctttgcatcataaagtgttgccaccgaccattaacgtcagtaagcccaatcctaaattaaacattcaggactcgccgttttatttaaacaccgaaacccgtccatggttacctcgtacagacaatacgccgcgccgcgcgggtattagtgcctttggttttggtggcaccaacttccacattgtgttggaagaataccgccaagaacatgttcgaggcgataaatatcgtcaacgttccgtgccgcaaagtctactaatccatgctgaaaataaagctgcattacaggctcaattaacagccctgcaaactgaagttaaggctgttgataccacacagcaaaatcgtcaagaaattgtgttggctgattttggtaaacgttttgccttaacgaccatagcccccaaagccgcgcgcataggcttagtggtggcatcattagctgacttaaccattcagctgactcaagcgctggcgcaattgagttcgaatactgccgacagctggcaattgccttctggcaccagttatcgctcagcagcattaattcatcctgaatcggcaagccataaagtggcggcattatttgccggacaaggggcgcagtatctgaacatgggcgtcgatttagcctgtttttatccagaaatgcgtcaacaattgatgcaagcagataaggtatttgcgcaacataaacaaatgccactatcgcaaataatgtaccctaccccggcttttgaagccgaagatattgccgcacaacacgcagcattaaccaatactgccaatgcccaaagtgctattggtgcagtgagcatgggccaatatgcattattgactcaagcaggttttaaagccgatatggtggccggtcatagttttggtgaactgtcagcattatgtgctgcgggggtcattagccaagctgattattatcaattggcctttgctcgtggccaagcaatggcggcaacgcctaaagatcaagatgctggcgtgatgtacgccattattgtccccgctcaagctgctgaccaaggtgttgaaaagcttgaacagtgcattagtgcatttgagggcgtcaaagtggctaattacaatgcaccaacccaactggttattgcaggtccaacagcatcatgtaccttagcggcacaagcaatcaccgctgaacttggttttaaagcaatcgccctgccggtttctggcgcattccacacgccattagtggcgcatgcgcaacaaccctttgctgcggccatcgataaggttaaatttgctaagccaaaactaagcctttatgccaatggcacaggtaaagcacatccaaatgatcctaaagcaatcaaggcagcatttactgatcatatgctgcagtcagttcgttttagcgagcaattaaccgctatgtatgacgctggcgcacgagtatttgttgagtttggtcctaaaaacatcctccataaattggttgaggcgaccttaggcaacaaagccgaatcagtcagcatagtgagcttgaacccaaatcctaaaggcaatagcgacactcaactgcgtcaagcagcgtgtcagcttgcggtattagggctggcattaaccgaggttgatccttatcaagcgcccatcgctgaacttgcaaaagtgtcaccgatgaacgtcaagttaactgcgagtaattatattagcgccaccacccaagccaaaatgaacaagtcgctgcaaactggcacagttaccagcaaaacagtagaagtaccggttgagaaaattgtggaaaaaattgtggaaaaagaagtgattaaaactgaatacattgaagtgcctgcaacatcagcaccagcctctgcggttgccgcacctttggcggcaacgacggctgtagcggctaaaccaattagcgcaaatgtgcctgcgtcggccgatagtatcggtgcattttttgctgcgcagcaacaaacggcgcaattacatcagcaatttttagccataccacagcaatatggcgacacgtttgctcatttgatgacagcgcaagcacaaatggcatcatcgggattagccattcctgaaagcttgcaacgttctatggagctgttccaccagcatcaagcacaaacattgcaaagtcacagtcaatttttaacgctgcaagcgcaagcaagtcaagctgcattagccatgttacaagggcaaacaccaatgccagcgtcgacgtcagcaccagtagctgcggcatctatgcagcctgcatttgtgccccaaagccaagttgctcaggccacaacgacgccttcgactgtggtagctcctgttgctgctgctcaagttcaaccagctcaagcggttcaatctcaacagactgccagtaaaccagtccaggctcctgtagctcagcaagtgagttcgcttgcagtttcagccccaacagcaggactatcgcagcaacaagtgttagacactatgctcaatgtggtcgcagataaaaccggttacccaactgaaatgcttgaacttagcatggacatggaagccgatttaggtatcgactccatcaaacgcgtcgaaattttaggcacagtacaagatgagctgccaggtttacctgaactgagcccagaagatttagccgaatgtcgcaccttaggtgaaatcgttagctacatgcaaactaaattacctgctgctaatgcagttagtgttgcgtctgctgcaccagttgcggcaaacaccgcaactgcatcaactggcttaacagctgaaaacgttcagcgcaccatgctcgctgtggttgccgataaaaccggttacccaactgaaatgcttgaacttggcatggacatggaagccgatttaggtatcgactctatcaaacgcgtcgaaattttaggtacagtacaagatgaactgccaggcttacctgaactgagcccagaagatttagccgaatgtcgcaccttaggtgaaatcgttagctacatgcaaaccaaattgcctgctgccaatgcagttagtgtagcgtcctctgcaccagtcgcggcaaacactgcaactgcatcaactggcttaacagctgaaaacgtccaacgcaccatgctcgctgtggttgccgataaaaccggttaccctactgaaatgctcgaacttggcatggacatggaagctgacctcggtatcgactctatcaaacgcgtcgaaattttaggcacagtacaagatgagctgccaggtttacctgagctgagcccagaagatttagccgagtgtcgcaccttgggcgaaatcgtcagctacatgcaaactaaactgcctgcagccattacagtggcaccagtagcaaccgtctcttcatcttcatctacagcaccaacaacgggcttaagtgctgatacggtattaagcactatgatgtcagtcgtcgccgacaaaaccggttaccctgctgaaatgcttgaactgagcatggacatggaagccgatttaggcatcgactcaatcaaacgtgttgaaattctaggtacagtgcaagatgagctgccaggcttacctgaactcagcccagaagatttagccgagtatcgcactttgggcgaaatcgtcagctacatgcaaaccaaactgcctgcagccattacagtggcaccagtagcaaccgtctcttcatctacagcaccgacaacgggcttgagtgctgatacagtattaagcaccatgatgtcagtcgtcgccgacaaaaccggttacccagctgaaatgcttgaactgagcatggacatggaagcggatttaggtatcgactcaatcaaacgggtcgagattttaggcacagtacaagatgagttgcctggcttacctgagcttaacccagaagatttagccgaatgtcgcaccttaggtgaaatcgtcagctacatgcaaaccaaattgcctgcagcgacctcaaccgcgattgcggctgtctccccagcatcaacggcaaataaggttgaggttaacaccgcagcattaccgccacacagcgaggtagcgctaaaaaagttacccgcggcggataaactcgtagattgttattcagcaaaaaactgtattgtcatcacagatgatggccataacgccggtttactcgctgaaaaactcactgcaaagggattaaccgtcgccgttattcgtaacccacaaaccatcagcgtagcgcattcaccattaagcagtgatattaaaagctacaccttgagcagcattgatgatgcgcacattgctcaggtgattgccgatattaaagccgacttgggcgctgaacatgccattgcaggttttgttcatttacagccgcaaacgctagtaaataatcacccattaatgtcatgtactcttgctgcaaaagccgctgtcgacaacgcgttcttatgggctaagcatcttcacccagaatttgctaaaccgacgtcttcgcgtctgtgctactttaccgtgagtcgtttagacggcgggtttggctacttagataatgaccaattagccacagcggaactgaatcaagcggccttatctgggctgagcaaaaccttaagccatgagtggccacaagtattttgccgtgccttagacattagcaataatattgatgctacaagctttgccgatgccatagttgctgagttgtttgatatcgatggtgccaatgcaagcgtagatcgcattaatgaagtggggattagtcagcaaggtcgagtaaccttagtcgccgccaatgccagtgagcagtttgcgccagcaacgcttgatggtaatgacactattttggtcaccggcggcgcaaaaggggtaacgtttgaatgcgccctcaccttagccaaacaatgccaatcacattttgtgttagcaggtcgtagccaacattttggcagcgacttaccggcttgggcacaaggcaagcaagcctctgagttaaaagccgcggccattgcttatattcaatcgcaaggcaataaacccacgccaaaacaaattgatgcattagtgtggccaattagcagcagcctagaaatcgatgctgcgttagccgctttcagtaaggtcggcgccagcgcgcaatatgtctcaatggatgtcagcgacgccacagcggtagccgcctgccttaacagcctgacgaatgctaagggcgacccgttaaccattaatggcgttattcacggcgcaggggtgttagccgacaagcatattcaagacaaaaccttggatgaacttaaccgcgtttatcacactaaagtgaccgggcttgcaagtataattaatgcactcgacccacaacagatcaagctgattgccttgttttcatcggctgccggtttctacggaaataccggacaaagcgattatgctatgtcgaatgaaatcctcaataaaaccgcccttaaactggcacacaccttagcgcatgctaaagtaatgagttttaactggggcccttgggatggcggaatggtcagttcggcattaaagaaaatgtttgttgatcgcggtgtttacgtgattccattacaagcaggtgccgagttatttgcccacagtttattaagtcagcaaggcgcacaattgcttattggctcagatatgcaaggttcatcagatcaggataatgctgtaaaaaagcttaatgcggacgctttgcttatcgccaagggttcgctgacgtttgcagctaagacacagtcctctgatcttatcagtatgacggtgactcgagtcttaaccccggctgaaatgccttttgttagcgatcattgtattgctggtaatccggtattgccgacagtatgtgccatgcaatggatgcgtgatgcagcacaaaccttatgtcatgtgcctgtcagtattgctgaatataaattgcttaaaggggttatttttgacaccaatgagccacatttgctgcaactggaactaacgcaaactgacgctgggatcaacgcgctgatctcatctcgtttgttaaatgagccaagtgcagcgatgaaaccgcaatatcaagcaacattagtgatcaatagcgccgtcttgactgatgatattgccaagcccgtgattgatacagcgagcctgacaaagtggtcgcatatagtgccgttgagctcaggggttgaactgtatcaaaacggaaccttgtttcatggcccacgtttgcaaggcattaagcaagtgttggcatttgatgatgctcagctcttgtgccaagtgcaattaccgcagattaataccgctgactgtgaacgttttatcccatcatcggcattaggtggcagccaagttttcgcggaagatttgctgctacaagccatgctggtatgggccagacttaaatacggtgcggccagtttaccttcatcaacggctgaatgtgttaccgcttggccatttgccagtggtgataaaggctatattcaactggatgttgttaaacacagcggcagaatgttaatcgctaacgtgagtttataccatcaagatggtcgcttgagttgccaaatgctcaacgctaaagtgactatcagtaaaagtttgaatggggcttttattccacatcaagcggctactggtgtgtctcaccacagcaaggaaacagtgtga

SEQ ID NO: 142 - protein, 2616 aa, Shewanella sp.
  misc_feature: PfaA polypeptide
  misc_feature: SGI Peptide ID NO. 1513783
  misc_feature: Useful for modulating production of PUFA
  misc_feature (1)..(2616): NCBI GI: 114562399 Blast Desc: beta-ketoacyl synthase [Shewanella frigidimarina NCIMB 400] gi|114333692|gb|ABI71074.1| beta-ketoacyl synthase [Shewanella frigidimarina NCIMB 400]
  misc_feature (1)..(2616): NCBI GI: 149675716 Blast Desc: beta-ketoacyl synthase [Shewanella livingstonensis]
  misc_feature (1)..(2599): NCBI GI: 91793978 Blast Desc: beta-ketoacyl synthase [Shewanella denitrificans OS217] gi|91715980|gb|ABE55906.1| beta-ketoacyl synthase [Shewanella denitrificans OS217]
  misc_feature (2)..(2600): NCBI GI: 90413869 Blast Desc: omega-3 polyunsaturated fatty acid synthase PfaA [Photobacterium profundum 3TCK] gi|90325053|gb|EAS41563.1| omega-3 polyunsaturated fatty acid synthase PfaA [Photobacterium
  misc_feature (2)..(2600): NCBI GI: 15488031 Blast Desc: AF409100_7 omega-3 polyunsaturated fatty acid synthase PfaA [Photobacterium profundum SS9]
  misc_feature (5)..(2605): NCBI GI: 126173663 Blast Desc: beta-ketoacyl synthase [Shewanella baltica OS155] gi|386340420|ref|YP_006036786.1| polyketide-type polyunsaturated fatty acid synthase PfaA [Shewanella baltica OS117] beta-ketoacyl
  misc_feature (5)..(2616): NCBI GI: 371994232 Blast Desc: polyketide-type polyunsaturated fatty acid synthase PfaA [Shewanella baltica OS183] gi|373948820|ref|ZP_09608781.1| polyketide-type polyunsaturated fatty acid synthase PfaA baltica
  misc_feature (5)..(2616): NCBI GI: 160874571 Blast Desc: polyketide-type polyunsaturated fatty acid synthase PfaA [Shewanella baltica OS195] gi|378707821|ref|YP_005272715.1| polyketide-type polyunsaturated fatty acid synthase PfaA baltica
  misc_feature (5)..(2616): NCBI GI: 353537327 Blast Desc: polyketide-type polyunsaturated fatty acid synthase PfaA [Shewanella baltica OS625]
  misc_feature (5)..(2616): NCBI GI: 206570564 Blast Desc: PfaA [Shewanella sp. BR-2]
  misc_feature (18)..(295): Pfam Id: PF00109 Pfam Desc: Beta-ketoacyl synthase, N-terminal domain
  misc_feature (303)..(420): Pfam Id: PF02801 Pfam Desc: Beta-ketoacyl synthase, C-terminal domain
  misc_feature (602)..(927): Pfam Id: PF00698 Pfam Desc: Acyl transferase domain
  misc_feature (1228)..(1295): Pfam Id: PF00550 Pfam Desc: Phosphopantetheine attachment site
  misc_feature (1334)..(1400): Pfam Id: PF00550 Pfam Desc: Phosphopantetheine attachment site
  misc_feature (1439)..(1505): Pfam Id: PF00550 Pfam Desc: Phosphopantetheine attachment site
  misc_feature (1544)..(1609): Pfam Id: PF00550 Pfam Desc: Phosphopantetheine attachment site
  misc_feature (1646)..(1711): Pfam Id: PF00550 Pfam Desc: Phosphopantetheine attachment site
  misc_feature (2006)..(2077): Pfam Id: PF00106 Pfam Desc: short chain dehydrogenase
  misc_feature (2006)..(2234): Pfam Id: PF08659 Pfam Desc: KR domain
  misc_feature (2093)..(2219): Pfam Id: PF00106 Pfam Desc: short chain dehydrogenase
MSQSSNKDKRLNKRLKDMPVAIVGMASIFANSRYINKFWDLISEKIDAIIDVPETHWNAEDYYNADKSMADKTYCKRGGFLPEVDFNPMEFGLPPNILELTDTSQLLSLVVAKEVLADAGIDAQYDTDRIGITLGVGGGQKINHSLSGRLQYPILKKVFKNSGLSDADTEMLIKKFQDQYIHWEENSFPGSLGNVIAGRIANRFDLGGMNCVVDAACAGSLAAMRMAITELVEGRSDMMITGGVCTDNSPSMYMSFSKTPAFTTNDTIQPFDIDSKGMMIGEGIGMMALKRLDDAERDGDRIYAVIKGIGSSSDGKFKSIYAPRPEGQAKALRRAYDDAGFAPHTVGLIEAHGTGTAAGDVAEFNGLKSVFTEDNDTQQHIALGSVKSQVGHTKSTAGTAGVIKVALALHHKVLPPTINVSKPNPKLNIQDSPFYLNTETRPWLPRTDNTPRRAGISAFGFGGTNFHIVLEEYRQEHVRGDKYRQRSVPQSLLIHAENKAALQAQLTALQTEVKAVDTTQQNRQEIVLADFGKRFALTTIAPKAARIGLVVASLADLTIQLTQALAQLSSNTADSWQLPSGTSYRSAALIHPESASHKVAALFAGQGAQYLNMGVDLACFYPEMRQQLMQADKVFAQHKQMPLSQIMYPTPAFEAEDIAAQHAALTNTANAQSAIGAVSMGQYALLTQAGFKADMVAGHSFGELSALCAAGVISQADYYQLAFARGQAMAATPKDQDAGVMYAIIVPAQAADQGVEKLEQCISAFEGVKVANYNAPTQLVIAGPTASCTLAAQAITAELGFKAIALPVSGAFHTPLVAHAQQPFAAAIDKVKFAKPKLSLYANGTGKAHPNDPKAIKAAFTDHMLQSVRFSEQLTAMYDAGARVFVEFGPKNILHKLVEATLGNKAESVSIVSLNPNPKGNSDTQLRQAACQLAVLGLALTEVDPYQAPIAELAKVSPMNVKLTASNYISATTQAKMNKSLQTGTVTSKTVEVPVEKIVEKIVEKEVIKTEYIEVPATSAPASAVAAPLAATTAVAAKPISANVPASADSIGAFFAAQQQTAQLHQQFLAIPQQYGDTFAHLMTAQAQMASSGLAIPESLQRSMELFHQHQAQTLQSHSQFLTLQAQASQAALAMLQGQTPMPASTSAPVAAASMQPAFVPQSQVAQATTTPSTVVAPVAAAQVQPAQAVQSQQTASKPVQAPVAQQVSSLAVSAPTAGLSQQQVLDTMLNVVADKTGYPTEMLELSMDMEADLGIDSIKRVEILGTVQDELPGLPELSPEDLAECRTLGEIVSYMQTKLPAANAVSVASAAPVAANTATASTGLTAENVQRTMLAVVADKTGYPTEMLELGMDMEADLGIDSIKRVEILGTVQDELPGLPELSPEDLAECRTLGEIVSYMQTKLPAANAVSVASSAPVAANTATASTGLTAENVQRTMLAVVADKTGYPTEMLELGMDMEADLGIDSIKRVEILGTVQDELPGLPELSPEDLAECRTLGEIVSYMQTKLPAAITVAPVATVSSSSSTAPTTGLSADTVLSTMMSVVADKTGYPAEMLELSMDMEADLGIDSIKRVEILGTVQDELPGLPELSPEDLAEYRTLGEIVSYMQTKLPAAITVAPVATVSSSTAPTTGLSADTVLSTMMSVVADKTGYPAEMLELSMDMEADLGIDSIKRVEILGTVQDELPGLPELNPEDLAECRTLGEIVSYMQTKLPAATSTAIAAVSPASTANKVEVNTAALPPHSEVALKKLPAADKLVDCYSAKNCIVITDDGHNAGLLAEKLTAKGLTVAVIRNPQTISVAHSPLSSDIKSYTLSSIDDAHIAQVIADIKADLGAEHAIAGFVHLQPQTLVNNHPLMSCTLAAKAAVDNAFLWAKHLHPEFAKPTSSRLCYFTVSRLDGGFGYLDNDQLATAELNQAALSGLSKTLSHEWPQVFCRALDISNNIDATSFADAIVAELFDIDGANASVDRINEVGISQQGRVTLVAANASEQFAPATLDGNDTILVTGGAKGVTFECALTLAKQCQSHFVLAGRSQHFGSDLPAWAQGKQASELKAAAIAYIQSQGNKPTPKQIDALVWPISSSLEIDAALAAFSKVGASAQYVSMDVSDATAVAACLNSLTNAKGDPLTINGVIHGAGVLADKHIQDKTLDELNRVYHTKVTGLASIINALDPQQIKLIALFSSAAGFYGNTGQSDYAMSNEILNKTALKLAHTLAHAKVMSFNWGPWDGGMVSSALKKMFVDRGVYVIPLQAGAELFAHSLLSQQGAQLLIGSDMQGSSDQDNAVKKLNADALLIAKGSLTFAAKTQSSDLISMTVTRVLTPAEMPFVSDHCIAGNPVLPTVCAMQWMRDAAQTLCHVPVSIAEYKLLKGVIFDTNEPHLLQLELTQTDAGINALISSRLLNEPSAAMKPQYQATLVINSAVLTDDIAKPVIDTASLTKWSHIVPLSSGVELYQNGTLFHGPRLQGIKQVLAFDDAQLLCQVQLPQINTADCERFIPSSALGGSQVFAEDLLLQAMLVWARLKYGAASLPSSTAECVTAWPFASGDKGYIQLDVVKHSGRMLIANVSLYHQDGRLSCQMLNAKVTISKSLNGAFIPHQAATGVSHHSKETV

SEQ ID NO: 143 - DNA, 2169 bp, Shewanella sp.
  misc_feature: PfaB gene
  misc_feature: SGI cDNA ID NO. 1513784
  misc_feature: Encodes the peptide sequence at SEQ ID NO 144
  misc_feature: Useful for modulating production of PUFA
atggtgctaaacacgatgagtgagcgtattgcaaagcaacaaactaagcctattcgtttagctttgttgctcagcaagcctaatattgcctcgattaatgaacacctgatcactgtcgacactcatagtgtcgacggctttgcattggcgttattgcacgcttgcgaacacctatcgtccaccagcaatgacatggtcaacattggcgatcgattgtggataatgtctgggttaattgcggctaaaaacggtattcatgcgcatgcttatatcaatggtattgcactgagtaacaaccaaactgaagcggtaacacttgcccttaagcatgcaaaacgtctgcatgctcagccacagatagtcgcgctagatggctgttataattttagtgcaagttctgatggcaatgccactgatgatgcagtgacggatccagctaatgattctagatctgagtccgctcctcatgcaagtgcgccccatacgaatgagacggcacaaacagcactgacggcaatggtcaacctagtcgagtctatcgcgagtcgctgtataccagcccaagacaaggctaacggtcaatattggtttagcgcatttcaccaaagccgagtcgcagctttatgttatccaaccgcatcaggtgttcaggcaatcatccttacccaaggtcgtgcacttatcgccgccaagccgttaatcagtactcaacgtttatggctgccgcttagcgccgcttcattggcgcaattgcacactaagctgatgggcctttcttcgcagttacactcagccattaacgacataagcttactcgagcttatcaaaaccagtttgttagattatcaaacagatgcaccgctagccctagtcttaatggcagccgatcgccgcgcattagtacaagaagtcagcgcgatgatgaccataatcgccactcatcagcagcatgatgtgaatagtcatacgccgatagaatataaaacgcctgcgggcagttgcttatattcagcgccgctgggtcataatggcttgagctttgtttatcctggcgttggcactgtgtacccaaacatgcttagtcaaataggcctggttttcccggatttgtttgctgaacttgaaaaccaaggtgacatgcaatcgatgttacaaacggactttatctatgcggcagataaaaatcgtgccgcacagatgagcctgagccaattagccattgctggtgttggcgccagttatattttaaccaagctgttgcagcaagaatttgccattgagcctcgttttgctttgggttattccatgggtgaagcggccatgtgggcgagtttaaacgtatggcaaacaccgcacagcatgattgcagccacgcaaaacagcagtatttttacccgagatatttctggtgagctccgctgtgttcgccaacaatggcaattagccgatgacgaaaacattgtatggaatagcttcgttactcgagccagcattgacgaactcgcgccccatttagccaattaccctcgggcttatattgctattattcagggtgatacctgtgttgttgccggctgtgaaaacagttgtaaagccttactaaagcaagctggtaaacgcggcattgccgctaatcgcgtcaccgcaatgcacacgcctgcggcattgaacattagcgaatcagtaaggcaattttatcaacaaccattagtagaaaacttaccaagccaattgcagtttatctccgcagcagagactcagcctgttgtattaacctcacaagccattgcaaaatcgattgccgatactttttgtcatcagctcaattttactcagttaattcttaatgctcgagagcaaggctgtcgactatttgttgaagtaggtgccgatcggcaaactaccaccctaattgacaaaatcaatgcgcagagtagcaatagcgtctcagcgatggcaatggccgtcaatgctaaaggtggcgatgacgtcaccagtttacttaaatgcctagggcaactaattgctcatcgagtgcccatgtcattaagcccttttattcgcagccttgacgctagcattaatacattatcccagcaggcggcattagccgacggctcatccctcatttgttatagtgaaacatcattagaaggagaacctcattga

SEQ ID NO: 144 - protein, 722 aa, Shewanella sp.
  misc_feature: PfaB polypeptide
  misc_feature: SGI Peptide ID NO. 1513784
  misc_feature: Useful for modulating production of PUFA
  misc_feature (1)..(722): NCBI GI: 114562398 Blast Desc: omega-3 polyunsaturated fatty acid synthase PfaB [Shewanella frigidimarina NCIMB 400] gi|114333691|gb|ABI71073.1| omega-3 polyunsaturated fatty acid synthase PfaB [Shewanella 400]
  misc_feature (1)..(722): NCBI GI: 219806606 Blast Desc: omega-3 polyunsaturated fatty acid synthase PfaB [Shewanella livingstonensis]
  misc_feature (1)..(722): NCBI GI: 91793979 Blast Desc: omega-3 polyunsaturated fatty acid synthase PfaB [Shewanella denitrificans OS217] gi|91715981|gb|ABE55907.1| omega-3 polyunsaturated fatty acid synthase PfaB [Shewanella
  misc_feature (10)..(722): NCBI GI: 336310879 Blast Desc: omega-3 polyunsaturated fatty acid synthase subunit, PfaB [Shewanella sp. HN-41] gi|335865559|gb|EGM70575.1| omega-3 polyunsaturated fatty acid synthase subunit, PfaB [Shewanella sp.
  misc_feature (61)..(698): NCBI GI: 371994231 Blast Desc: PfaB family protein [Shewanella baltica OS183] gi|373948819|ref|ZP_09608780.1| PfaB family protein [Shewanella baltica OS183] gi|386325340|ref|YP_006021457.1| PfaB family PfaB
  misc_feature (61)..(706): NCBI GI: 386340419 Blast Desc: PfaB family protein [Shewanella baltica OS117] gi|334862820|gb|AEH13291.1| PfaB family protein [Shewanella baltica OS117]
  misc_feature (61)..(706): NCBI GI: 126173662 Blast Desc: PfaB family protein [Shewanella baltica OS155] gi|125996867|gb|ABN60942.1| omega-3 polyunsaturated fatty acid synthase PfaB [Shewanella baltica OS155]
  misc_feature (61)..(709): NCBI GI: 217974088 Blast Desc: PfaB family protein [Shewanella baltica OS223] gi|217499223|gb|ACK47416.1| PfaB family protein [Shewanella baltica OS223]
  misc_feature (72)..(698): NCBI GI: 386313104 Blast Desc: omega-3 polyunsaturated fatty acid synthase, PfaB [Shewanella putrefaciens 200] gi|319425729|gb|ADV53803.1| omega-3 polyunsaturated fatty acid synthase, PfaB [Shewanella 200]
  misc_feature (72)..(698): NCBI GI: 120599575 Blast Desc: omega-3 polyunsaturated fatty acid synthase PfaB [Shewanella sp. W3-18-1] gi|146292428|ref|YP_001182852.1| omega-3 polyunsaturated fatty acid synthase PfaB [Shewanella putrefaciens
  misc_feature (347)..(650): Pfam Id: PF00698 Pfam Desc: Acyl transferase domain
MVLNTMSERIAKQQTKPIRLALLLSKPNIASINEHLITVDTHSVDGFALALLHACEHLSSTSNDMVNIGDRLWIMSGLIAAKNGIHAHAYINGIALSNNQTEAVTLALKHAKRLHAQPQIVALDGCYNFSASSDGNATDDAVTDPANDSRSESAPHASAPHTNETAQTALTAMVNLVESIASRCIPAQDKANGQYWFSAFHQSRVAALCYPTASGVQAIILTQGRALIAAKPLISTQRLWLPLSAASLAQLHTKLMGLSSQLHSAINDISLLELIKTSLLDYQTDAPLALVLMAADRRALVQEVSAMMTIIATHQQHDVNSHTPIEYKTPAGSCLYSAPLGHNGLSFVYPGVGTVYPNMLSQIGLVFPDLFAELENQGDMQSMLQTDFIYAADKNRAAQMSLSQLAIAGVGASYILTKLLQQEFAIEPRFALGYSMGEAAMWASLNVWQTPHSMIAATQNSSIFTRDISGELRCVRQQWQLADDENIVWNSFVTRASIDELAPHLANYPRAYIAIIQGDTCVVAGCENSCKALLKQAGKRGIAANRVTAMHTPAALNISESVRQFYQQPLVENLPSQLQFISAAETQPVVLTSQAIAKSIADTFCHQLNFTQLILNAREQGCRLFVEVGADRQTTTLIDKINAQSSNSVSAMAMAVNAKGGDDVTSLLKCLGQLIAHRVPMSLSPFIRSLDASINTLSQQAALADGSSLICYSETSLEGEPH

SEQ ID NO: 145 - DNA, 5910 bp, Shewanella sp.
  misc_feature: PfaC gene
  misc_feature: SGI cDNA ID NO. 1513785
  misc_feature: Encodes the peptide sequence at SEQ ID NO 146
  misc_feature: Useful for modulating production of PUFA
ttgagttctcaagctacccctaaaatagccattgtcggtttagccaatcagtatccagacgcggatactcccgctaaattttggcaaaacttattagacaaaaaagattcgcgcagccaaatcagtgccagcaaactcaatgcttcaccgcgtgactacttgggtatacaaggcgaatcggaccgtttttattgcgataaaggcggctacattcaagactttcaatttaatcctcaaggttatcgcattgaggccagcgcatttaatggcttagacgatagcttcttgtgggcaaccgacacagcacgtaatgcgttaacggatgctggtattgaccttgacgatagcttgcttaaacgtaccggtattgtgatgggaaccttatcattccctacggctaaatctaatgaactgtttgtacctctgtatcacagcgcggtcgaaaaagccttacagaccaagctgcaacagccaaactttagcctacactgtttcaataatagcgttaacaagagttgtgatcagccacaagctaatcacgctgccaccgctcaaccggttaacttaggtaatggtgccattgcccataatgcctcgaaaattgttgccgatgctttgggtttgggcggtacgcagctgagtttagatgcagcctgtgctagctcggtttacgccttaaaactcgcctgtgattacttgcatactggcaaggcagatatgatgttagctggcgctgtgtctggcgcagatccattcttcatcaatatgggcttttcgatatttcacgcttatccagaccatggaatttcagcgccctttgatcgtaacagtaaaggcttattcgccggcgaaggtgcgggggtattagtgcttaaacgccttgaagacgctgaacgtgatggcgaccatatctatgctttagtcagtggtatcggtttatcaaacgacggtaaaggtcagtttgtgttaagcccgaatagcaaaggccaagtactagcattcgagcgcgcttatcgcgatgcggcagcaatagacccaagtattacccctgccagtattgaagtgattgaatgccatgccacgggaacgccattaggcgataaagtagaattaacctcaatggaacgcttttttgaagataaacttcaaggcagcgcgacgccactgattggttcagccaaatctaatctaggccatttactcaccgcggcaggcatgcctgggatcatgaaaatgatttttgccatgcgccaaggcgtgttgccaccgagtattaatatcagtgccccaatctcatcacctaatggattatttggtcaagcgaccttacccaatgtggtcttgccttggcctgataaagccggtaataaagcccgtcatgcaggtgtttcggtatttggttttggcggttgtaacgcccatttactgatcgagtcctatcaagatcaggcaggcataaaccatgctgacagtaaacgctctcagcttagtcgcagcaaaatagtcagtacagaaacgccaatgcacattaccggcatggcagcccactttggtcagtgcagcagcatcaatgcattggctgataaaatcatcaataagcaaccactgtttagcccattgcccaatcaacgctggaaaggcttagacaagcaccctgagttattggctcaatatggcatacatcaggtgccacaaggggcgtatattgatcagttcgattttgattttttacgtttcaaagtgccgcctaatgaagatgatcgcctgatatcgcaacaactgttattaatcaaaatagcagatgaagccattgccaatgccaagctaacgcctggcagtaaagtagccgtgttggttgccatggaaaccgaacttgaattacaccaatttcgcggtcgagttaacttacatagccaaatagcgcaaagccttaatgcccaagggatccagttatctagtgctgaatatgccagccttgaagcaattgcgatggacagtgttttagatgccgccaagctaaatcaatataccagcttcattggtaacattatggcgtcacggatctcctcattatgggatttcaatggcccggcatttaccatttcagctggtgcacagtcagttaatcgttgtatcgatgtggcgcaaaacttatttgctcttggttcgttacaagagcctttggatgccatcatcatcgccgcggtagatctttccggcagcattgaaaatatgttattcaatactgccaagcttaatgctaaaggattaagctcaaccgactggaaagtaggtgaaggcgctggcgcgatagtgttgcaacaaactaatgcagcacatcctgagcttgacagctatgccagcataaacagtattgattttgactcattatcacaacgcccggccaacattgcagcagatcttatcgaattaaaccaatcgcctgaatgcatattaacaactcaaggccaacagtttgtccaaggattaactgatgctgcagcggtcaactcagcgccgttgttgagtaaagcacaagatattctcggtcacacctttgccgcttctggcatggccagtttactgcacgctttagtacaaagccgccatattgataaatcggccatcaacaccagtgtattcaccagcagcgaaacccaatactcacaggttaatctgtctgtttcggcgccgcagcaacacgcattgcgtactcgtctgagcaacaatttgacgcaacaattagccacaggcaataagttaagcttaattaagcaagttagtttaggtggccgagatatctatcaacatattattgatagctcacttgaaggtctcaacagcattgtggctcaatgcgccaatatcacaacaatggccgacagcaatctagatcaatgtgctgataccacttcagcaatagctaaaatcattgacacaactaagccaaaaaccacctgtgacagcagccactttagtgtcaatcatagcgagcatatcgccgagtctcttatgtcagaaaacaccgtttcaacagcagagcaacctaaggttgccagtgtgacaagcccgaccataccgccagcacatttaagtgcatttcagcaaaatcaatggttagcgcagcaagcgcacttagcctacttatccagccgagatgcggggttaaaagtcgccgacagtttattacgttcacaattagccggtttaaccagccagcaaatatcttatgtgtcgcaggcttcacagcctgctgtaaatgtagatcctatcgcctcagcagctgtacctgtggaattaattcaacctaatcatgcttgtgtgccagcttacaccgcgccgatcccagcggataaaccgtgtatttggaattatgctgatttagtcgagtatgccgaaggcgatatcgctaaggtatttggcccagattatgccattatcgacggctattctcgtcgagtaagactgcccaccacagattatttgttggtgtcgcgcgtcactaaacttgatgcgaccatgaatcaatacaaaccttgttcaatgaccactgaatacgacatcccagtcgatgcgccatatttagtcgatggtcaaatcccttgggctgtagcagtagaatcgggtcaatgtgatttaatgttgatcagttacttaggcatcgattttgaaaacaagggcgaacgggtttatcgtttattagattgtactttgactttcttagaagatttacctcgtggcggtgacacgctgcgttacgatataaaaatcaataactttgctagcaatggcgatacgttattattctttttctcttacgaatgcttcgtaggcgacaagatgatcctcaaaatggatggcggctgcgcaggcttctttaccgaccaagaactggccgatggtaaaggggttattcaaactgaagatgaaataaaacgtcgtcaacaagtgctcaataatccaaacaaaccgaccttcacgccattactacactgtagccaaacggcatttgattatggccaaattcatcatttactgaccggcgatattggcagctgttttggcggtgaacacgtcgcccaccagctacaaaatggtatgcaaaaatcgctttgttttgcctcagaaaagttcttaatgattgagcgtgttagtcaattacaaactcaaggtggtgcttggggcttaggcttactcgaaggtcataagcatattgcgccagatcattggtatttcccttgtcatttccaaggcgaccaagtgatggccggatcgctaatggcagaaggttgtggtcaactattacagttctttatgatccatattggcatgcatactctcgtcgagaatggccgattccagcctctggaaaacgcctcacaaaaagtccgctgtcgtggccaagtgttaccacaaaccgccgaactgacttatcgcatggaagtgactgaaataggcattcatcctcgcccttacgccaaagctaatattgatattttacttaatggcaaagttgtggtcgatttccaaaacttaggcgtgatgattaaagaagaggctgaatgtacgcgttatccacttatctcgttaaacacagcaaacactagcactgccgttgattcagacgctagcagtaaagtgatggctaacaaagcgccattaatggcgcaagttccagatttacatgccccgagtaacaagggcgttattccgctaaaacaccttgaagcgcccatcgtaagtgccgattcaaagtatgctaatcgcgtgcctgataccgtaccatttacgccataccatatgttcgaatttgccacaggcgatatcgaaaagtgctttggcccagactttagtatttaccgcggattgatcccgccgcgtacaccctgtggcgatttacagttaaccacgcgcgtcgttgaaattaacggtaagcgcggcgaactgaaaaagccatcatcgtgtatcgcagagtacgaagtgccggcagatgcttggtactttgcaaaaaacagccatcaagcggtaatgccttactcagtgctaatggaaatttcactacaacctaacggttttatctcaggctatatgggcaccactcttggcttccccgggcaagagctgtttttccgtaatttagatggtagcggtaaattattgcgccatgtggatttacgcggtaaaaccatagtcaatgactcaaagctattatcaaccgttatcgctggcagtaacattattcaaagcttcacctttgaattaagtgttgataacgagccgttttacactggtagtgcggtatttggttacttcaaaggtgatgcgctaaagaaccagcttggtattgataatggcaggatcacccagccttggcatatcgataataatgtcgcggcagacattagcgtcaacttactggataaacagtcgcgagtatttaatgcaccagcgagccaaccgcattatcgccttgcgggcggccagcttaactttatcgataaagccgaaattgttaacactggtggcaaatacgctaagggctatcttgctgcgtcacgcacgattgacccaagtgattggttcttccaatttcacttccatcaagatccggttatgccgggttcattaggtgttgaagccgtgatcgagttgatgcaaacttacgccatctctacagacttaggtaaaggtttcaccaatccgaaatttggtcaaatattgtcggatattaagtggaaatatcgcggtcaaattaatccgcttaacaaacaaatgtcacttgatgtgcatatcagtgcagtaaaagatgaagacggtaagcgcatcataataggcgatgcaaacctcagtaaagatggtctacgcatttatgaagtcaaagacatcgcaatctgtattgaagaagcttag

SEQ ID NO: 146 - protein, 1969 aa, Shewanella sp.
  misc_feature: PfaC polypeptide
  misc_feature: SGI Peptide ID NO. 1513785
  misc_feature: Useful for modulating production of PUFA
  misc_feature (1)..(1969): NCBI GI: 114562397 Blast Desc: Beta-hydroxyacyl-(acyl-carrier-protein) dehydratase, FabA/FabZ [Shewanella frigidimarina NCIMB 400] gi|114333690|gb|ABI71072.1| dehydratase, FabA/FabZ [Shewanella
  misc_feature (1)..(1969): NCBI GI: 91793980 Blast Desc: 3-hydroxyacyl-ACP dehydratase [Shewanella denitrificans OS217] gi|91715982|gb|ABE55908.1| Beta-hydroxyacyl-(acyl-carrier-protein) dehydratase, FabA/FabZ
  misc_feature (1)..(1969): NCBI GI: 126173661 Blast Desc: Beta-hydroxyacyl-(acyl-carrier-protein) dehydratase FabA/FabZ [Shewanella baltica OS155] gi|386340418|ref|YP_006036784.1| synthase I., dehydratase baltica
  misc_feature (1)..(1969): NCBI GI: 336310878 Blast Desc: omega-3 polyunsaturated fatty acid synthase subunit, PfaC [Shewanella sp. HN-41] gi|335865558|gb|EGM70574.1| omega-3 polyunsaturated fatty acid synthase subunit, PfaC [Shewanella sp.
  misc_feature (2)..(1969): NCBI GI: 120599576 Blast Desc: Beta-hydroxyacyl-(acyl-carrier-protein) dehydratase, FabA/FabZ [Shewanella sp. W3-18-1] gi|146292427|ref|YP_001182851.1| dehydratase, FabA/FabZ CN-32]
  misc_feature (2)..(1969): NCBI GI: 152999949 Blast Desc: beta-hydroxyacyl-(acyl-carrier-protein) dehydratase FabA/FabZ [Shewanella baltica OS185] gi|151364567|gb|ABS07567.1| Beta-hydroxyacyl-(acyl-carrier-protein) dehydratase FabA/FabZ
  misc_feature (2)..(1969): NCBI GI: 160874569 Blast Desc: beta-hydroxyacyl-(acyl-carrier-protein) dehydratase FabA/FabZ [Shewanella baltica OS195] gi|378707819|ref|YP_005272713.1| dehydratase FabA/FabZ baltica
  misc_feature (2)..(1969): NCBI GI: 206570566 Blast Desc: PfaC [Shewanella sp. BR-2]
  misc_feature (8)..(297): Pfam Id: PF00109 Pfam Desc: Beta-ketoacyl synthase, N-terminal domain
  misc_feature (12)..(1969): NCBI GI: 386313103 Blast Desc: multi-domain beta-ketoacyl synthase, PfaC [Shewanella putrefaciens 200] gi|319425728|gb|ADV53802.1| multi-domain beta-ketoacyl synthase, PfaC [Shewanella putrefaciens 200]
  misc_feature (125)..(1969): NCBI GI: 219806608 Blast Desc: Beta-hydroxyacyl-(acyl-carrier-protein) dehydratase, FabA/FabZ [Shewanella livingstonensis]
  misc_feature (305)..(427): Pfam Id: PF02801 Pfam Desc: Beta-ketoacyl synthase, C-terminal domain
  misc_feature (507)..(775): Pfam Id: PF00109 Pfam Desc: Beta-ketoacyl synthase, N-terminal domain
  misc_feature (1375)..(1509): Pfam Id: PF07977 Pfam Desc: FabA-like domain
  misc_feature (1827)..(1960): Pfam Id: PF07977 Pfam Desc: FabA-like domain
MSSQATPKIAIVGLANQYPDADTPAKFWQNLLDKKDSRSQISASKLNASPRDYLGIQGESDRFYCDKGGYIQDFQFNPQGYRIEASAFNGLDDSFLWATDTARNALTDAGIDLDDSLLKRTGIVMGTLSFPTAKSNELFVPLYHSAVEKALQTKLQQPNFSLHCFNNSVNKSCDQPQANHAATAQPVNLGNGAIAHNASKIVADALGLGGTQLSLDAACASSVYALKLACDYLHTGKADMMLAGAVSGADPFFINMGFSIFHAYPDHGISAPFDRNSKGLFAGEGAGVLVLKRLEDAERDGDHIYALVSGIGLSNDGKGQFVLSPNSKGQVLAFERAYRDAAAIDPSITPASIEVIECHATGTPLGDKVELTSMERFFEDKLQGSATPLIGSAKSNLGHLLTAAGMPGIMKMIFAMRQGVLPPSINISAPISSPNGLFGQATLPNVVLPWPDKAGNKARHAGVSVFGFGGCNAHLLIESYQDQAGINHADSKRSQLSRSKIVSTETPMHITGMAAHFGQCSSINALADKIINKQPLFSPLPNQRWKGLDKHPELLAQYGIHQVPQGAYIDQFDFDFLRFKVPPNEDDRLISQQLLLIKIADEAIANAKLTPGSKVAVLVAMETELELHQFRGRVNLHSQIAQSLNAQGIQLSSAEYASLEAIAMDSVLDAAKLNQYTSFIGNIMASRISSLWDFNGPAFTISAGAQSVNRCIDVAQNLFALGSLQEPLDAIIIAAVDLSGSIENMLFNTAKLNAKGLSSTDWKVGEGAGAIVLQQTNAAHPELDSYASINSIDFDSLSQRPANIAADLIELNQSPECILTTQGQQFVQGLTDAAAVNSAPLLSKAQDILGHTFAASGMASLLHALVQSRHIDKSAINTSVFTSSETQYSQVNLSVSAPQQHALRTRLSNNLTQQLATGNKLSLIKQVSLGGRDIYQHIIDSSLEGLNSIVAQCANITTMADSNLDQCADTTSAIAKIIDTTKPKTTCDSSHFSVNHSEHIAESLMSENTVSTAEQPKVASVTSPTIPPAHLSAFQQNQWLAQQAHLAYLSSRDAGLKVADSLLRSQLAGLTSQQISYVSQASQPAVNVDPIASAAVPVELIQPNHACVPAYTAPIPADKPCIWNYADLVEYAEGDIAKVFGPDYAIIDGYSRRVRLPTTDYLLVSRVTKLDATMNQYKPCSMTTEYDIPVDAPYLVDGQIPWAVAVESGQCDLMLISYLGIDFENKGERVYRLLDCTLTFLEDLPRGGDTLRYDIKINNFASNGDTLLFFFSYECFVGDKMILKMDGGCAGFFTDQELADGKGVIQTEDEIKRRQQVLNNPNKPTFTPLLHCSQTAFDYGQIHHLLTGDIGSCFGGEHVAHQLQNGMQKSLCFASEKFLMIERVSQLQTQGGAWGLGLLEGHKHIAPDHWYFPCHFQGDQVMAGSLMAEGCGQLLQFFMIHIGMHTLVENGRFQPLENASQKVRCRGQVLPQTAELTYRMEVTEIGIHPRPYAKANIDILLNGKVVVDFQNLGVMIKEEAECTRYPLISLNTANTSTAVDSDASSKVMANKAPLMAQVPDLHAPSNKGVIPLKHLEAPIVSADSKYANRVPDTVPFTPYHMFEFATGDIEKCFGPDFSIYRGLIPPRTPCGDLQLTTRVVEINGKRGELKKPSSCIAEYEVPADAWYFAKNSHQAVMPYSVLMEISLQPNGFISGYMGTTLGFPGQELFFRNLDGSGKLLRHVDLRGKTIVNDSKLLSTVIAGSNIIQSFTFELSVDNEPFYTGSAVFGYFKGDALKNQLGIDNGRITQPWHIDNNVAADISVNLLDKQSRVFNAPASQPHYRLAGGQLNFIDKAEIVNTGGKYAKGYLAASRTIDPSDWFFQFHFHQDPVMPGSLGVEAVIELMQTYAISTDLGKGFTNPKFGQILSDIKWKYRGQINPLNKQMSLDVHISAVKDEDGKRIIIGDANLSKDGLRIYEVKDIAICIEEA

SEQ ID NO: 147 - DNA, 1629 bp, Shewanella sp.
  misc_feature: PfaD gene
  misc_feature: SGI cDNA ID NO. 1513786
  misc_feature: Encodes the peptide sequence at SEQ ID NO 148
  misc_feature: Useful for modulating production of PUFA
atgacaacacaagtgcacaacgaaaagctttctccttggccatggcaagttagccagcaacacgttagctttgatcaaactgggatgaacaaaaagctcaaagatttatcacaagcgtgttatttggttaacgacgcgcaacaaggcttaggcgtggcgcaacaagctcaagtggtgaccgacgcagttaatgcacctaacactttacctgtaagcgcttttggacctgcactgggtacccaaagtttaggcgacagtaattttcgccgcgtgcatggggtaaaatatgcctattatgctggcgcgatggctaatggcatttcctcggaagaattggttatcgcgttaggccaagcaggtattttatgttcgtttggcgcagctgggttaattccatctcgagttgaacaagcgataaaccgcatccaagccgcgctgcccaatgggccatatgcgtttaacttaatccacagcccaagtgagccagcgcttgagcgtggtagtgttgagctatttttaaaatataaagtgcgcacggttgaggcctcagcctttttaggcttaaccccacaaatagtctattaccgcgcagcaggcttaagccgcgatgctcatggtgatattcaaatcgacaataaagtgattgctaaaattagccgcaccgaagtcgcgattaagtttatgcaaccagcacctgttaaaatgctgcaacaacttgttgatgatggcctcattagcgcagagcaaatggaactggcacaacttgtaccaatggcggatgatattaccgctgaagccgactctggtggccataccgacaaccgtccattagtgacgttactgcccactattttggcgttaaaagatgaagtgcaagcgcaatacaaatacaaaacacctatccgtgttggcgcgggtggcggtgtgggtacacccgatgccgcgctggctacgtttcatatgggcgcagcctatattgttaccggatcaattaaccaagcctgtgtggaagcgggggctagcgagcatacgcgcaaattactggcaacgaccgaaatggccgatgtgactatggcacccgctgctgatatgttcgaaatgggggtcaagttacaagtggtcaagcgtggcacattattcccgatgcgagccaacaagttgtatgaaatttacagccgttatgactcaatagaagcgattccaagtgacgaacgcgaaaaacttgaaaaacaagtattccgctcaagcctagatgatatttgggctggtactgtcgcgcattttaatgagcgcgacccaaagcaaattgaacgtgctaaagacaatccaaaacgtaaaatggccttgattttccgttggtatcttggcttatcaagccgctggtcaaactctggtgaggtcggccgtgaaatggattatcaaatttgggcaggcccagcattaggcgcatttaacgcttgggctaaaaatagttatttagatgactacagccaacgtcatgcagtagacttagcgaaacatttaatgcatggggcagcttatttggccagagtgaatttattgacggcgcaaggcgttagccttccagtagcattacagcgttggcgcccaattgatcaaataaaatag

SEQ ID NO: 148 - protein, 542 aa, Shewanella sp.
  misc_feature: PfaD polypeptide
  misc_feature: SGI Peptide ID NO. 1513786
  misc_feature: Useful for modulating production of PUFA
  misc_feature (1)..(542): NCBI GI: 219806610 Blast Desc: omega-3 polyunsaturated fatty acid synthase PfaD [Shewanella livingstonensis]
  misc_feature (1)..(542): NCBI GI: 114562396 Blast Desc: 2-nitropropane dioxygenase [Shewanella frigidimarina NCIMB 400] gi|114333689|gb|ABI71071.1| 2-nitropropane dioxygenase, NPD [Shewanella frigidimarina NCIMB 400]
  misc_feature (1)..(541): NCBI GI: 91793981 Blast Desc: Sden_2630 [Shewanella denitrificans OS217] gi|91715983|gb|ABE55909.1| conserved [Shewanella denitrificans OS217]
  misc_feature (1)..(541): NCBI GI: 218710186 Blast Desc: omega-3 polyunsaturated fatty acid synthase PfaD [Vibrio splendidus LGP32] gi|218323205|emb|CAV19382.1| PfaD, omega-3 polyunsaturated fatty acid synthase [Vibrio splendidus
  misc_feature (6)..(541): NCBI GI: 371994229 Blast Desc: PfaD family protein [Shewanella baltica OS183] gi|373948817|ref|ZP_09608778.1| PfaD family protein [Shewanella baltica OS183] gi|386325342|ref|YP_006021459.1| PfaD family PfaD
  misc_feature (6)..(541): NCBI GI: 120599577 Blast Desc: 2-nitropropane dioxygenase [Shewanella sp. W3-18-1] gi|146292426|ref|YP_001182850.1| 2-nitropropane dioxygenase [Shewanella putrefaciens CN-32] gi|120559670|gb|ABM25597.1| NPD
  misc_feature (6)..(540): NCBI GI: 336310877 Blast Desc: enoyl-[acyl-carrier-protein] reductase [FMN] , inferred for PFA pathway [Shewanella sp. HN-41] gi|335865557|gb|EGM70573.1| enoyl-[acyl-carrier-protein] [FMN] ,
  misc_feature (6)..(541): NCBI GI: 152999948 Blast Desc: PfaD family protein [Shewanella baltica OS185] gi|160874568|ref|YP_001553884.1| PfaD family protein [Shewanella baltica OS195] gi|378707818|ref|YP_005272712.1| PfaD family PfaD
  misc_feature (6)..(541): NCBI GI: 386313102 Blast Desc: omega-3 polyunsaturated fatty acid synthase subunit, PfaD [Shewanella putrefaciens 200] gi|319425727|gb|ADV53801.1| omega-3 polyunsaturated fatty acid synthase subunit, PfaD 200]
  misc_feature (6)..(541): NCBI GI: 126173660 Blast Desc: PfaD family protein [Shewanella baltica OS155] gi|386340417|ref|YP_006036783.1| PfaD family protein [Shewanella baltica OS117] gi|125996865|gb|ABN60940.1| 2-nitropropane NPD
  misc_feature (88)..(363): Pfam Id: PF03060 Pfam Desc: Nitronate monooxygenase
MTTQVHNEKLSPWPWQVSQQHVSFDQTGMNKKLKDLSQACYLVNDAQQGLGVAQQAQVVTDAVNAPNTLPVSAFGPALGTQSLGDSNFRRVHGVKYAYYAGAMANGISSEELVIALGQAGILCSFGAAGLIPSRVEQAINRIQAALPNGPYAFNLIHSPSEPALERGSVELFLKYKVRTVEASAFLGLTPQIVYYRAAGLSRDAHGDIQIDNKVIAKISRTEVAIKFMQPAPVKMLQQLVDDGLISAEQMELAQLVPMADDITAEADSGGHTDNRPLVTLLPTILALKDEVQAQYKYKTPIRVGAGGGVGTPDAALATFHMGAAYIVTGSINQACVEAGASEHTRKLLATTEMADVTMAPAADMFEMGVKLQVVKRGTLFPMRANKLYEIYSRYDSIEAIPSDEREKLEKQVFRSSLDDIWAGTVAHFNERDPKQIERAKDNPKRKMALIFRWYLGLSSRWSNSGEVGREMDYQIWAGPALGAFNAWAKNSYLDDYSQRHAVDLAKHLMHGAAYLARVNLLTAQGVSLPVALQRWRPIDQIK

SEQ ID NO: 149 - DNA, 888 bp, Shewanella sp.
  misc_feature: PfaE gene
  misc_feature: SGI cDNA ID NO. 1513827
  misc_feature: Encodes the peptide sequence at SEQ ID NO 150
  misc_feature: Useful for modulating production of PUFA
atgtttaatagagccttgtttgttttaatgtctgttacatctcctataaactcatctcagccgctttttcagccacatatttattttgtgccactggatggcgcgctttgtgctgcagattatgaggctggtttagccttaaattggttaaccgatgacgaggttgctaaggttagtcgttacagaagtcaatcggcgcgcaatactggtttacaagtgcgtttagcgcttcgggctattatgtcacttcatagtgatttaaaaccttttgagtggcgttttagctatggtgctaaaggtaaaccggcgcttagcgaagacttattggttcaaactgggctgcattttaatttgagccatagcggcgattggctaatgatcggcattgtcagtaataagcaagcatatgccgctgaaacagccttgtcatttggtgttgatattgagcgtgaacgcagcagtaccaaaatagaagctattttgaatcactacttttctgctgttgaaatagaagatttgatggcattgccgcttgagttacaacgccaacgtttttttgatttatgggcgttgaaagaggcctttattaaagcaacaggcaaagggctggcgcagtcgttaacctcttttgggtttacatttgctgctaatagcgtgtttgaagctgttaatgagcaatatcctactatcgcagcgagtgattatatccatttttcagcgctcgattatcacgagccgcaatggcagttttactttggccgattaagcccatattaccgcttcagcgtgtgtattggtgatatgcaatctcagtctttgctgcacataaaagcgccaacgatgtcgataatttcgttggcgcaattaataccttcttcacacgactag

SEQ ID NO: 150 - protein, 295 aa, Shewanella sp.
  misc_feature: PfaE polypeptide
  misc_feature: SGI Peptide ID NO. 1513827
  misc_feature: Useful for modulating production of PUFA
  misc_feature (12)..(289): NCBI GI: 206570562 Blast Desc: 4'-phosphopantetheinyl transferase [Shewanella sp. BR-2]
  misc_feature (12)..(289): NCBI GI: 152999953 Blast Desc: 4'-phosphopantetheinyl transferase [Shewanella baltica OS185] gi|151364571|gb|ABS07571.1| 4'-phosphopantetheinyl transferase [Shewanella baltica OS185]
  misc_feature (12)..(266): NCBI GI: 126173665 Blast Desc: 4'-phosphopantetheinyl transferase [Shewanella baltica OS155] gi|386340422|ref|YP_006036788.1| 4'-phosphopantetheinyl transferase [Shewanella baltica OS117] 4'-phosphopantetheinyl
  misc_feature (12)..(289): NCBI GI: 217974085 Blast Desc: 4'-phosphopantetheinyl transferase [Shewanella baltica OS223] gi|217499220|gb|ACK47413.1| 4'-phosphopantetheinyl transferase [Shewanella baltica OS223]
  misc_feature (12)..(289): NCBI GI: 371994234 Blast Desc: 4'-phosphopantetheinyl transferase [Shewanella baltica OS183] gi|373948822|ref|ZP_09608783.1| 4'-phosphopantetheinyl transferase [Shewanella baltica OS183] 4'-phosphopantetheinyl
  misc_feature (12)..(289): NCBI GI: 160874573 Blast Desc: 4'-phosphopantetheinyl transferase [Shewanella baltica OS195] gi|378707823|ref|YP_005272717.1| 4'-phosphopantetheinyl transferase [Shewanella baltica OS678] 4'-phosphopantetheinyl
  misc_feature (12)..(289): NCBI GI: 353537329 Blast Desc: 4'-phosphopantetheinyl transferase [Shewanella baltica OS625]
  misc_feature (19)..(266): NCBI GI: 18542421 Blast Desc: AF467805_1 phosphopantetheinyl transferase [Shewanella sp. SC2A]
  misc_feature (19)..(266): NCBI GI: 149675712 Blast Desc: 4'-phosphopantetheinyl transferase [Shewanella livingstonensis]
  misc_feature (19)..(266): NCBI GI: 114562423 Blast Desc: 4'-phosphopantetheinyl transferase [Shewanella frigidimarina NCIMB 400] gi|114333716|gb|ABI71098.1| 4'-phosphopantetheinyl transferase [Shewanella frigidimarina 400]
  misc_feature (145)..(207): Pfam Id: PF01648 Pfam Desc: 4'-phosphopantetheinyl transferase superfamily
MFNRALFVLMSVTSPINSSQPLFQPHIYFVPLDGALCAADYEAGLALNWLTDDEVAKVSRYRSQSARNTGLQVRLALRAIMSLHSDLKPFEWRFSYGAKGKPALSEDLLVQTGLHFNLSHSGDWLMIGIVSNKQAYAAETALSFGVDIERERSSTKIEAILNHYFSAVEIEDLMALPLELQRQRFFDLWALKEAFIKATGKGLAQSLTSFGFTFAANSVFEAVNEQYPTIAASDYIHFSALDYHEPQWQFYFGRLSPYYRFSVCIGDMQSQSLLHIKAPTMSIISLAQLIPSSHD

SEQ ID NO: 151 - DNA, 872 bp, Schizochytrium sp.
  misc_feature: alpha-tubulin promoter
gcaggggtgctagtattttatactatctggatgctaggaggcaagacttcttttgcctgtctgtctgtttgtctatctggctacccctattgtatcttatatcccaaacactagggctccctcacctgcaacagtcagtcactcacgcattcagtatatactaaggctcacctagactaatccataagcagccaatccgttccgcgctcgcgccggtagaagcaaccggaccatacggaggtcttagtgtttaggttatatgggctatgtcttatcggtgggccgttatacacgccgcgctggaagctcctctactttgtgaggagtttcacttataatgtatgatcgggattcctgttcccctcccatccactgggtgcaaaattcaactccctcacaaaaagtgcattatataaatatatgtaaaggcaacggtcgctacctctaagtacactgaggatataaacaagagcaagatggaagttttcagtatttgttgtgaggaacaccactggaggccaaaacaggcctcttagagggttctccactggcaagcctcgacggtttggcgcagagtgagggcagcaaactttgccgcatcgcagcaaatctcaatcagccttttgacggtcgtgcctaacaacacgccgttcaccccaagccttactttgccttcgtgcattgtcctcgagtatcgtaagtttgattcgctttcattcgcttccatccactccggtcgtagcaaaagcaaagcagcgttgtgcggctctcaaggtttagccctgatgcgatcgaagagcataaactaactagcctccgtcttggtttcgtttcacagttaagtagttttcgaaactccaacctcaagcaaa

SEQ ID NO: 152 - DNA, 20 bp, Artificial Sequence
  Unknown PCR primer 155pfaA_fwd1
tacaggtgggcttgacgccg

SEQ ID NO: 153 - DNA, 24 bp, Artificial Sequence
  Unknown PCR primer 155 pfaA_rev1
gaccatcatcggtgatcacaacac

SEQ ID NO: 154 - DNA, 23 bp, Artificial Sequence
  Unknown PCR primer 254pfaA fwd1
aggcgagattgttgattacatgc

SEQ ID NO: 155 - DNA, 20 bp, Artificial Sequence
  Unknown PCR primer 254pfaA rev1
tctcgacgcgcttgattgag

SEQ ID NO: 156 - DNA, 24 bp, Artificial Sequence
  Unknown PCR primer 771pfaA_fwd1
cagctgcacctgtaactacatcag

SEQ ID NO: 157 - DNA, 20 bp, Artificial Sequence
  Synthesized primer sequence
actgctggcgcaactgctac

SEQ ID NO: 158 - DNA, 27 bp, Artificial Sequence
  Synthesized primer sequence
agtgcttttaactaagaattattagtc

SEQ ID NO: 159 - DNA, 46 bp, Artificial Sequence
  Synthesized primer sequence
tcctctagagtcgacctgcagtagttatttttcaaactgcaaattc

SEQ ID NO: 160 - DNA, 51 bp, Artificial Sequence
  Synthesized primer sequence
gccaagcttgcatgcctgcagggcaggggtgctagtattttatactatctg

SEQ ID NO: 161 - DNA, 25 bp, Artificial Sequence
  Synthesized primer sequence
cattttgcttgaggttggagtttcg

SEQ ID NO: 162 - DNA, 60 bp, Artificial Sequence
  Synthesized primer sequence
cacagtaaagtagttttcgaaactccaacctcaagcaaaatgagccagtcttctcaccag

SEQ ID NO: 163 - DNA, 49 bp, Artificial Sequence
  Synthesized primer sequence
gatttcaattcaattcaatgcggccgcttcagacgctgtccttagagtg

SEQ ID NO: 164 - DNA, 60 bp, Artificial Sequence
  Synthesized primer sequence
acagtaaagtagttttcgaaactccaacctcaagcaaaatgactacccagctcaagaacg

SEQ ID NO: 165 - DNA, 52 bp, Artificial Sequence
  Synthesized primer sequence
gatttcaattcaattcaatgcggccgctctacttaacttgatcagcaggacg

SEQ ID NO: 166 - DNA, 60 bp, Artificial Sequence
  Synthesized primer sequence
tcacagtaaagtagttttcgaaactccaacctcaagcaaaatgcctattcacgctgctgt

SEQ ID NO: 167 - DNA, 50 bp, Artificial Sequence
  Synthesized primer sequence
gatttcaattcaattcaatgcggccgctctacttgttgttgaggaggtcg

SEQ ID NO: 168 - DNA, 60 bp, Artificial Sequence
  Synthesized primer sequence
atgactacccagctcaagaacgagaagctttctccttggccttggcaggtttctcagcag

SEQ ID NO: 169 - DNA, 60 bp, Artificial Sequence
  Synthesized primer sequence
tggcaggtttctcagcagcatgtgtctttcgatcctgctggcattaacaagaagctcaag

SEQ ID NO: 170 - DNA, 45 bp, Artificial Sequence
  Synthesized primer sequence
cgaaactccaacctcaagcaaaatgacccttagcgttaacgctat

SEQ ID NO: 171 - DNA, 40 bp, Artificial Sequence
  Synthesized primer sequence
aattcttagttaaaagcacttcagtgaggttcgccttcag

SEQ ID NO: 172 - DNA, 44 bp, Artificial Sequence
  Synthesized primer sequence
cgaaactccaacctcaagcaaaatgtcttctcaggctaccccta

SEQ ID NO: 173 - DNA, 41 bp, Artificial Sequence
  Synthesized primer sequence
aattcttagttaaaagcactctaggcctcctcgatgcaaat

SEQ ID NO: 174 - DNA, 20 bp, Artificial Sequence
  Synthesized primer sequence
cagcaatgtcttgagcttcg

What is claimed is:

1. A recombinant eukaryotic microorganism comprising at least one non-native nucleic acid sequence encoding a prokaryotic Type A polyunsaturated fatty acid (PUFA) polyketide synthase (PKS) system comprising a pfaA gene, a pfaB gene, a pfaC gene, a pfaD gene, and a pfaE gene, wherein the pfaA gene encodes a polypeptide comprises comprising an amino acid sequence having at least 98% identity to SEQ ID NO:2, the pfaB gene encodes a polypeptide comprises comprising an amino acid sequence having at least 96% identity to SEQ ID NO:4, the pfaC gene encodes a polypeptide comprises comprising an amino acid sequence having at least 98% identity to SEQ ID NO:6, the pfaD gene encodes a polypeptide comprises comprising an amino acid sequence having at least 96% identity to SEQ ID NO:8, and the pfaE gene encodes a polypeptide comprises comprising an amino acid sequence having at least 96% identity to SEQ ID NO: 10;

wherein the recombinant eukaryotic microorganism produces at least 50% more eicosapentaenoic acid (EPA) than a control eukaryotic microorganism.

2. A recombinant eukaryotic microorganism according to claim 1, wherein the recombinant eukaryotic microorganism produces at least 75% more EPA than a control eukaryotic microorganism.

3. A recombinant eukaryotic microorganism according to claim 2, wherein the eukaryotic microorganism produces at least 100% more EPA than a control eukaryotic microorganism.

4. A recombinant eukaryotic microorganism according to claim 1, wherein the eukaryotic microorganism is a labyrinthulomycete.

5. A recombinant eukaryotic microorganism according to claim 4, wherein the eukaryotic microorganism is of a genus selected from the group consisting of *Aurantiochytrium, Oblongichytrium, Schizochytrium, Thraustochytrium*, and *Ulkenia*.

6. A recombinant eukaryotic microorganism according to claim 1, wherein the PUFA-PKS system is derived from a prokaryotic species of a genus selected from the group consisting of *Shewanella, Vibrio, Aliivibrio, Pseudoaltermonas, Labyrinthuloides*, and *Psychromonas*.

7. A recombinant eukaryotic microorganism according to claim 1, wherein at least one non-native nucleic acid sequence is operably linked to a heterologous promoter.

8. A method for producing EPA, comprising culturing a recombinant eukaryotic microorganism according to claim 1 to produce EPA.

9. A method according to claim 8, further comprising recovering EPA from the culture.

10. A method for according to claim 8, wherein said culturing is performed at a temperature greater than 20° C.

11. A method for according to claim 10, wherein said culturing is performed at a temperature greater than 25° C.

12. A method for according to claim 11, wherein said culturing is performed at a temperature of at least 30° C.

* * * * *